(12) United States Patent
Severinov et al.

(10) Patent No.: US 11,060,115 B2
(45) Date of Patent: Jul. 13, 2021

(54) CRISPR ENZYMES AND SYSTEMS

(71) Applicants: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US); RUTGERS, THE STATE UNIVERSITY OF NEW JERSEY, New Brunswick, NJ (US); SKOLKOVO INSTITUTE OF SCIENCE AND TECHNOLOGY, Moscow (RU); The United States of America, as represented by, the Secretary, Department of Health and Human Services, Bethesda, MD (US)

(72) Inventors: Konstantin Severinov, Piscataway, NJ (US); Feng Zhang, Cambridge, MA (US); Yuri I. Wolf, Bethesda, MD (US); Sergey Shmakov, Moscow (RU); Ekaterina Semenova, Piscataway, NJ (US); Leonid Minakhin, Piscataway, NJ (US); Kira S. Makarova, Bethesda, MD (US); Eugene Koonin, Bethesda, MD (US); Silvana Konermann, Zurich (CH); Julia Joung, Boston, MA (US); Jonathan S. Gootenberg, Cambridge, MA (US); Omar O. Abudayyeh, Boston, MA (US); Eric S. Lander, Cambridge, MA (US)

(73) Assignees: The Broad Institute, Inc., Cambridge, MA (US); Massachusetts Institute of Technology, Cambridge, MA (US); President and Fellows of Harvard College, Cambridge, MA (US); Rutgers, the State University of New Jersey, New Brunswick, NJ (US); Skolkovo Institute of Science and Technology, Moscow (RU); The United States of America, as represented by the Secretary, Department of Health and Human Services, Bethesda, MD (US)

(*) Notice: Subject to any disclaimer, the term of this patent is extended or adjusted under 35 U.S.C. 154(b) by 523 days.

(21) Appl. No.: 15/482,603

(22) Filed: Apr. 7, 2017

(65) Prior Publication Data
US 2017/0321198 A1 Nov. 9, 2017

Related U.S. Application Data

(63) Continuation-in-part of application No. PCT/US2016/038258, filed on Jun. 17, 2016.

(60) Provisional application No. 62/320,321, filed on Apr. 8, 2016, provisional application No. 62/296,522, filed on Feb. 17, 2016, provisional application No. 62/285,349, filed on Oct. 22, 2015, provisional application No. 62/181,675, filed on Jun. 18, 2015.

(51) Int. Cl.
| | |
|---|---|
| *C12N 15/90* | (2006.01) |
| *C12N 15/10* | (2006.01) |
| *C12N 15/63* | (2006.01) |
| *C12N 9/22* | (2006.01) |
| *C12N 15/11* | (2006.01) |
| *C12N 15/82* | (2006.01) |
| *C12N 15/85* | (2006.01) |
| *C12N 15/113* | (2010.01) |

(52) U.S. Cl.
CPC ............. *C12N 15/907* (2013.01); *C12N 9/22* (2013.01); *C12N 15/102* (2013.01); *C12N 15/111* (2013.01); *C12N 15/113* (2013.01); *C12N 15/63* (2013.01); *C12N 15/8201* (2013.01); *C12N 15/85* (2013.01); *C12N 2310/111* (2013.01); *C12N 2310/20* (2017.05); *C12N 2800/22* (2013.01)

(58) Field of Classification Search
CPC .... C12N 15/907; C12N 15/63; C12N 15/113; C12N 15/85; C12N 15/8201; C12N 15/111; C12N 9/22; C12N 15/102; C12N 2800/22; C12N 2310/111; C12N 2310/20
See application file for complete search history.

(56) References Cited

U.S. PATENT DOCUMENTS

| | | | |
|---|---|---|---|
| 4,873,316 A | 10/1989 | Meade et al. | |
| 5,543,158 A | 8/1996 | Gref et al. | |

(Continued)

FOREIGN PATENT DOCUMENTS

| | | | |
|---|---|---|---|
| EP | 0264166 A1 | 4/1988 | |
| EP | 1519714 A1 | 4/2005 | |

(Continued)

OTHER PUBLICATIONS

Witkowski et al., Biochemistry 38:11643-11650, 1999.*

(Continued)

*Primary Examiner* — Delia M Ramirez
(74) *Attorney, Agent, or Firm* — Johnson, Marcou, Isaacs & Nix, LLC; F. Brent Nix, Esq.; Rachel D. Rutledge, Esq.

(57) ABSTRACT

The invention provides for systems, methods, and compositions for targeting nucleic acids. In particular, the invention provides non-naturally occurring or engineered RNA-targeting systems comprising a novel RNA-targeting CRISPR effector protein and at least one targeting nucleic acid component like a guide RNA.

22 Claims, 348 Drawing Sheets
Specification includes a Sequence Listing.

(56) References Cited

U.S. PATENT DOCUMENTS

| | | |
|---|---|---|
| 5,563,055 A | 10/1996 | Townsend et al. |
| 5,580,859 A | 12/1996 | Felgner et al. |
| 5,589,466 A | 12/1996 | Felgner et al. |
| 5,593,972 A | 1/1997 | Weiner et al. |
| 5,789,156 A | 8/1998 | Bujard et al. |
| 5,814,618 A | 9/1998 | Bujard et al. |
| 5,846,946 A | 12/1998 | Huebner et al. |
| 5,855,913 A | 1/1999 | Hanes et al. |
| 5,985,309 A | 11/1999 | Edwards et al. |
| 6,007,845 A | 12/1999 | Domb et al. |
| 6,603,061 B1 | 8/2003 | Armstrong et al. |
| 6,750,059 B1 | 6/2004 | Blakesley et al. |
| 7,259,015 B2 | 8/2007 | Kingsman et al. |
| 7,303,910 B2 | 12/2007 | Bebbington et al. |
| 7,351,585 B2 | 4/2008 | Mitrophanous et al. |
| 7,745,651 B2 | 6/2010 | Heyes et al. |
| 7,776,321 B2 | 8/2010 | Cascalho et al. |
| 7,799,565 B2 | 9/2010 | MacLachlan et al. |
| 7,803,397 B2 | 9/2010 | Heyes et al. |
| 7,838,658 B2 | 11/2010 | MacLachlan et al. |
| 7,868,149 B2 | 1/2011 | Boukharov et al. |
| 7,901,708 B2 | 3/2011 | MacLachlan et al. |
| 7,915,399 B2 | 3/2011 | MacLachlan et al. |
| 7,982,027 B2 | 7/2011 | MacLachlan et al. |
| 8,044,019 B2 | 10/2011 | Uno et al. |
| 8,058,069 B2 | 11/2011 | Yaworski et al. |
| 8,101,741 B2 | 1/2012 | MacLachlan et al. |
| 8,188,263 B2 | 5/2012 | MacLachlan et al. |
| 8,236,943 B2 | 8/2012 | Lee et al. |
| 8,283,333 B2 | 10/2012 | Yaworski et al. |
| 8,372,951 B2 | 2/2013 | Chang et al. |
| 8,404,658 B2 | 3/2013 | Hajjar et al. |
| 8,454,972 B2 | 6/2013 | Nabel et al. |
| 8,575,305 B2 | 11/2013 | Gait et al. |
| 8,614,194 B1 | 12/2013 | Chen et al. |
| 8,642,295 B2 | 2/2014 | De Laat et al. |
| 8,697,359 B1 | 4/2014 | Zhang |
| 8,709,843 B2 | 4/2014 | Shakuda |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 2003/0087817 A1 | 5/2003 | Cox et al. |
| 2004/0013648 A1 | 1/2004 | Kingsman et al. |
| 2004/0142476 A1 | 7/2004 | Evans et al. |
| 2004/0171156 A1 | 9/2004 | Hartley et al. |
| 2005/0019923 A1 | 1/2005 | Uchegbu et al. |
| 2006/0281180 A1 | 12/2006 | Radcliffe et al. |
| 2007/0025970 A1 | 2/2007 | Kingsman et al. |
| 2007/0054961 A1 | 3/2007 | Maden et al. |
| 2008/0267903 A1 | 10/2008 | Uchegbu et al. |
| 2009/0007284 A1 | 1/2009 | Radcliffe et al. |
| 2009/0017543 A1 | 1/2009 | Wilkes et al. |
| 2009/0100536 A1 | 4/2009 | Adams et al. |
| 2009/0111106 A1 | 4/2009 | Mitrophanous et al. |
| 2010/0317109 A1 | 12/2010 | Maden et al. |
| 2011/0059502 A1 | 3/2011 | Chalasani |
| 2011/0117189 A1 | 5/2011 | Mazzone et al. |
| 2011/0195123 A1 | 8/2011 | Shemi |
| 2011/0265198 A1 | 10/2011 | Gregory et al. |
| 2011/0293571 A1 | 12/2011 | Widdowson et al. |
| 2011/0293703 A1 | 12/2011 | Mahon et al. |
| 2012/0003201 A1 | 1/2012 | Nicholas et al. |
| 2012/0017290 A1 | 1/2012 | Cui et al. |
| 2012/0251560 A1 | 10/2012 | Dahlman et al. |
| 2012/0251618 A1 | 10/2012 | Schrum et al. |
| 2012/0295960 A1 | 11/2012 | Palfi et al. |
| 2013/0185823 A1 | 7/2013 | Kuang et al. |
| 2013/0236946 A1 | 9/2013 | Gouble |
| 2013/0244279 A1 | 9/2013 | De Fougerolles et al. |
| 2013/0245107 A1 | 9/2013 | De Fougerolles et al. |
| 2013/0252281 A1 | 9/2013 | De Fougerolles et al. |
| 2013/0302401 A1 | 11/2013 | Ma et al. |
| 2014/0170753 A1 | 6/2014 | Zhang |
| 2014/0179006 A1 | 6/2014 | Zhang |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0227787 A1 | 8/2014 | Zhang |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0248702 A1 | 9/2014 | Zhang et al. |
| 2014/0256046 A1 | 9/2014 | Zhang et al. |
| 2014/0273231 A1 | 9/2014 | Zhang et al. |
| 2014/0273232 A1 | 9/2014 | Zhang et al. |
| 2014/0273234 A1 | 9/2014 | Zhang et al. |
| 2014/0287938 A1 | 9/2014 | Zhang et al. |
| 2014/0310830 A1 | 10/2014 | Zhang et al. |
| 2014/0335620 A1 | 11/2014 | Zhang et al. |
| 2014/0357530 A1 | 12/2014 | Zhang et al. |
| 2015/0184139 A1 | 7/2015 | Zhang et al. |

FOREIGN PATENT DOCUMENTS

| | | |
|---|---|---|
| EP | 1664316 A1 | 6/2006 |
| EP | 1766035 A1 | 3/2007 |
| EP | 1781593 A2 | 5/2007 |
| EP | 2764103 A2 | 8/2014 |
| EP | 2771468 A1 | 9/2014 |
| EP | 2784162 A1 | 10/2014 |
| EP | 3 009 511 A2 | 4/2016 |
| WO | 9301294 A1 | 1/1993 |
| WO | 9639154 A1 | 12/1996 |
| WO | 9703211 A1 | 1/1997 |
| WO | 2008042156 A1 | 4/2008 |
| WO | 2008064289 A2 | 5/2008 |
| WO | 2010061186 A2 | 6/2010 |
| WO | 2010096488 A1 | 8/2010 |
| WO | 2011028929 A3 | 3/2011 |
| WO | 2012135025 A2 | 10/2012 |
| WO | 2014018423 A2 | 1/2014 |
| WO | 2014093595 A1 | 6/2014 |
| WO | 2014093622 A2 | 6/2014 |
| WO | 2014093635 A1 | 6/2014 |
| WO | 2014093655 A2 | 6/2014 |
| WO | 2014093661 A2 | 6/2014 |
| WO | 2014093694 A1 | 6/2014 |
| WO | 2014093701 A1 | 6/2014 |
| WO | 2014093709 A1 | 6/2014 |
| WO | 2014093712 A1 | 6/2014 |
| WO | 2014093718 A1 | 6/2014 |
| WO | 2014204723 A1 | 12/2014 |
| WO | 2014204724 A1 | 12/2014 |
| WO | 2014204725 A1 | 12/2014 |
| WO | 2014204726 A1 | 12/2014 |
| WO | 2014204727 A1 | 12/2014 |
| WO | 2014204728 A1 | 12/2014 |
| WO | 2014204729 A1 | 12/2014 |
| WO | 2015089351 A1 | 6/2015 |
| WO | 2015089354 A1 | 6/2015 |
| WO | 2015089364 A1 | 6/2015 |
| WO | 2015089419 A2 | 6/2015 |
| WO | 2015089427 A1 | 6/2015 |
| WO | 2015089462 A1 | 6/2015 |
| WO | 2015089465 A1 | 6/2015 |
| WO | 2015089486 A2 | 6/2015 |
| WO | 2016205764 A1 | 12/2016 |

OTHER PUBLICATIONS

Tang et al., Phil Trans R Soc B 368:Mar. 18, 2012, Jan. 10, 2013.*
Seffernick et al., J. Bacteriol. 183(8):2405-2410, 2001.*

(56) References Cited

OTHER PUBLICATIONS

Sadowski et al., Current Opinion in Structural Biology 19:357-362, 2009.*
Deng et al., Molecular Microbiology 87(5):1088-1099, 2013.*
Molina et al., Gen Bank accession No. 6QZT_A, Oct. 4, 2019.*
Molina et al., Gen Bank accession No. 6QZT_B, Oct. 4, 2019.*
Molina et al., Gen Bank accession No. 6QZT_C, Oct. 4, 2019.*
Guo et al., PNAS 101(25):9205-9210, 2004.*
Xu, et al., "Gene Targeting using the Agrobacterium tumefaciens-Mediated CRISPR-Cas System in Rice", Rice, vol. 7, No. 1, May 2, 2014, 4 pages.
Yin, et al., "A Geminivirus-Based Guide RNA Delivery System for CRISPR/Cas9 Mediated Plant Genome Editing", Scientific Reports 5, Article No. 14926, Oct. 9, 2015, 10 pages.
Younis, et al., "RNA Interference (RNAi) Induced Gene Silencing: A Promising Approach of Hi-Tech Plant Breeding", International Journal of Biological Sciences, vol. 10, No. 10, 2014, 1150-1158.
Zetsche, et al., "A Split Cas9 Architecture for Inducible Genome Editing and Transcription Modulation", Nature Biotechnology, vol. 33, No. 2, Feb. 2015, 139-142.
Zhang, et al., "Structure-Based Prediction of Protein-Protein Interactions on a Genome-Wide Scale", Nature, vol. 490, Oct. 25, 2012, 556-560.
Zhao, et al., "Circular Chromosome Conformation Capture (4C) Uncovers Extensive Networks of Epigenetically Regulated Intra- and Interchromosomal Interactions", Nature Genetics, vol. 38, Oct. 8, 2006, 1341-1347.
Zhou, et al., "Exploiting SNPs for Biallelic CRISPR Mutations in the Outcrossing Woody Perennial Populus Reveals 4-coumumarate:CoA ligase Specificity and Redundancy", New Phytologist, vol. 208, 2015, 298-301.
Zhu, et al., "Crystal structure of Cmr2 suggests a nucleotide cyclase-related enzyme in type III CRISPR-Cas sytems", FEBS Letters, vol. 586, No. 6, 2012, 939-945.
Abil, et al., "Engineering Reprogrammable RNA-Binding Proteins for Study and Manipulation of the Transcriptome", Molecular BioSystems, The Royal Society of Chemistry, vol. 11, No. 10, 8 pages.
Anantharaman, et al., "Comprehensive Analysis of the HEPN Superfamily: Identification of Novel Roles in Intra-Genomic Conflicts, Defense, Pathogenesis and RNA Processing", Biology Direct, vol. 8, No. 15, Jun. 15, 2013, 1-28.
Anders, et al., "Structural Basis of PAM-Dependent Target DNA Recognition by the Cas9 Endonuclease", Nature, vol. 513, No. 7519, Sep. 2014, 569-573.
Belhaj, et al., "Plant Genome Editing Made Easy: Targeted Mutagenesis in Model and Crop Plants Using the CRISPR/Cas System", Plant Methods, vol. 9, No. 39, Oct. 11, 2013, 10 pages.
Biswas, et al., "Accurate Computational Prediction of the Transcribed Strand of CRISPR Non-Coding RNAs", Bioinformatics, vol. 30, No. 13, Jul. 1, 2014, 1805-1813.
Bocobza, et al., "Small Molecules that Interact with RNA: Riboswitch-Based Gene Control and its Involvement in Metabolic Regulation in Plants and Algae", The Plant Journal, vol. 79, No. 4, 2014, 693-703.
Brooks, et al., "Efficient Gene Editing in Tomato in the First Generation Using the Clustered Regularly Interspaced Short Palindromic Repeats/CRISPR-Associated9 System", Plant Physiology, vol. 166, No. 3, Nov. 2014, 1292-1297.
Caliando, et al., "Targeted DNA Degradation using a CRISPR Device Stably Carried in the Host Genome", Nature Communications, vol. 6, No. 6989, May 19, 2015, 10.
Canver, et al., "BCL11A Enhancer Dissection by Cas9-Mediated in Situ Saturating Mutagenesis", Nature, vol. 527, Nov. 12, 2015, 192-197.
Chen, et al., "Cut Site Selection by the Two Nuclease Domains of the Cas9 RNA-guided Endonuclease", The Journal of Biological Chemistry, vol. 289, Mar. 14, 2014, 13284-13294.
Chen, et al., "Genome-Wide CRISPR Screen in a Mouse Model of Tumor Growth and Metastasis", Cell, vol. 160, No. 6, Mar. 12, 2015, 1246-1260.
Chen, et al., "Predicting Peptide-Mediated Interactions on a Genome-Wide Scale", PLOS Computational Biology, vol. 11, No. 5, May 4, 2015, 13 pages.
Chen, et al., "RNA Imaging. Spatially Resolved, Highly Multiplexed RNA Profiling in Single Cells", Science, vol. 348, No. 6233, Apr. 24, 2015, aaa6090-1-aaa6090-14.
Chylinski, et al., "Classification and evolution of type II CRISPR-Cas systems", Nucleic Acid Research, vol. 42, No. 10, 2014, pp. 6091-6105.
Curtin, et al., "A Genome Engineering Toolbox for Legume Functional Genomics", Plant and Animal Genome XXII, Poster P209, Jan. 13, 2014, 1 pages.
Dahlman, et al., "Orthogonal Gene Knock Out and Activation with a Catalytically Active Cas9 Nuclease", Nature Biotechnology, vol. 33, No. 11, Nov. 2015, 1159-1161.
Dey, et al., "Toward a "Structural BLAST": Using Structural Relationships to Infer Function", Protein Science, vol. 22, No. 4, Apr. 2013, 359-366.
Feng, et al., "Efficient Genome Editing in Plants using a CRISPR/Cas System", Cell Research, vol. 23, Aug. 20, 2013, 1229-1232.
Gambino, et al., "Simultaneous Detection of Nine Grapevine Viruses by Multiplex Reverse Transcription-Polymerase Chain Reaction with Coamplification of a Plant RNA as Internal Control", Phytopathology, vol. 96, No. 11, 2006, 1223-1229.
Gasiunas, et al., "Cas9-crRNA Ribonucleoprotein Complex Mediates Specific DNA Cleavage for Adaptive Immunity in bacteria", PNAS, vol. 109, No. 39, Sep. 4, 2012, E2579-E2586.
Geary, et al., "A Single-Stranded Architecture for Cotranscriptional Folding of RNA Nanostructures", Science, vol. 345, No. 6198, Aug. 15, 2014, 799-804.
Goldfless, et al., "Direct and Specific Chemical Control of Eukaryotic Translation with a Synthetic RNA-Protein Interaction", Nucleic Acids Research, vol. 40, No. 9, e64, Jan. 12, 2012.
Green, "Current State of Herbicides in Herbicide-Resistant Crops", Society of Chemical Industry, Pest Management Science, vol. 70, No. 9, 2014, 7 pages.
Grynberg, et al., "HEPN: A Common Domain in Bacterial Drug Resistance and Human Neurodegenerative Proteins", Trends in Biochemical Sciences, vol. 28, No. 5, May 2003, 224-226.
Hayes, et al., "Toxins-Antitoxins: Diversity, Evolution and Function", Critical Reviews in Biochemistry and Molecular Biology, vol. 46, No. 5, 2011, 386-408.
Hebelstrup, et al., "The Future of Starch Bioengineering: GM Microorganisms or GM Plants?", Frontiers in Plant Science, vol. 6, Article 247, Apr. 23, 2015, 6 pages.
Hlavova, et al., "Improving Microalgae for Biotechnology—From Genetics to Synthetic Biology", Biotechnology Advances, vol. 33, Issue 6, Part 2, Nov. 2015, 1194-1203.
Jackson, et al., "A Conserved Structural Chassis for Mounting Versatile Crispr RNA-Guided Immune Responses", Molecular Cell, vol. 58, Issue 5, Jun. 4, 2015, 722-728.
Jackson, "Crystal Structure of the CRISPR RNA-Guided Surveillance Complex from *Escherichia coli*", Science, vol. 345, No. 6203, Sep. 2014, 1473-1479.
Jinek, et al., "A Programmable Dual-RNA-Guided DNA Endonuclease in Adaptive Bacterial Immunity", Science, vol. 337, No. 6096, Aug. 17, 2012, 816-821.
Jinek, et al., "Structures of Cas9 Endonucleases Reveal RNA-Mediated Conformational Activation", Science, vol. 343, Mar. 2014, 13 pages.
Kabadi, et al., "Multiplex CRISPR/Cas9-based Genome Engineering from a Single Lenttiviral Vector", Nucleic Acids Research, vol. 42, No. 19, e147, Aug. 13, 2014, 11.
Kapitonov, et al., "Evolution of the RAG1-RAG2 locus: both proteins came from the same transposon", n Biology Direct, 2015, pp. 1-8.
Kapitonov, et al., "RAG1 Core and V(D)J Recombination Signal Sequences Were Derived from Transib Transposons", PLOS Biology, vol. 3, Issue 6, e181, Jun. 2005, 14 pages.
Khachatryan, et al., "Study of Vector Boson Scattering and Search for New Physics in Events with Two Same-Sign Leptons and Two Jets", Physical Review Letters, vol. 114, Issue 5-6, Feb. 2, 2015.

(56) References Cited

OTHER PUBLICATIONS

Kiani, et al., "Cas9 gRNA Engineering for Genome Editing, Activation and Repression", Nature Methods, vol. 12, 2015, 1051-1054.
Kim, et al., "RNA Interference: Applications and Advances in Insect Toxicology and Insect Pest Management", Pesticide Biochemistry and Physiology, vol. 120, 2015, 109-117.
Konermann, et al., "Genome-Scale Transcriptional Activation by an Engineered CRISPR-Cas9 Complex", Nature, vol. 517, Jan. 29, 2015, 583-588.
Konermann, et al., "Optical Control of Mammalian Endogenous Transcription and Epigenetic States", Nature, vol. 500, No. 7463, Aug. 22, 2013, 472-476.
Koonin, et al., "CRISPR-Cas Evolution of an RNA-based adaptive immunity system in prokaryotes", RNA Biology, 10:5, May 2013, pp. 679-686.
Koonin, et al., "Evolution of Adaptive Immunity from Transposable Elements Combined with Innate Immune Systems", Nature Reviews Genetics, vol. 16, No. 3, Mar. 2015, 184-192.
Kozlov, et al., "Structural Basis of Defects in the Sacsin HEPN Domain Responsible for Autosomal Recessive Spastic Ataxia of Charlevoix-Saguenay (ARSACS)", The Journal of Biological Chemistry, vol. 286, No. 23, Jun. 10, 2011, 20407-20412.
Krupovic, et al., "Casposons: A New Superfamily of Self-Synthesizing DNA Transposons at the Origin of Prokaryotic CRISPR-Cas Immunity", BMC Biology, vol. 12, No. 36, 12 pages.
Kurth, et al., "Virus-Derived Gene Expression and RNA Interference Vector for Grapevine", Journal of Virology, vol. 86, No. 11, Jun. 2012, 6002-6009.
Lange, et al., "CRISPRmap: an automated classification of repeat conservation in prokaryotic adaptive immune systems", Nucleic Acids Research, vol. 41, No. 17, 2013, pp. 8034-8044.
Lowder, et al., "A CRISP/Cas9 Toolbox for Multiplexed Plant Genome Editing and Transcriptional Regulation", Plant Physiology, vol. 169., Oct. 1-15, 2015.
Ma, et al., "A Robust CRISPR/Cas9 System for Convenient, High-Efficiency Multiplex Genome Editing in Monocot and Dicot Plants", Molecular Plant, vol. 8, No. 8, Aug. 2015, 1274-1284.
MacKay, et al., "The Prospects for Designer Single-Stranded RNA-Binding Proteins", Nature Structural & Molecular Biology, vol. 18, No. 3, Mar. 2011, 256-261.
Makarova, et al., "Annotation and Classification of CRISPR-Cas Systems", Methods Mol Biol., 1311, 2015, pp. 47-75.
Makarova, et al., "Comprehensive Comparative-Genomic Analysis of Type 2 Toxin-Antitoxin Systems and Related Mobile Stress Response Systems in Prokaryotes", Biology Direct, vol. 4, No. 19, Jun. 3, 2009, 1-38.
Majumdar, et al., "Three CRISPR-Cas Immune Effector Complexes Coexist in Pyrococcus Furiosus", RNA, vol. 21, 2015, 1147-1158.
Makarova, et al., "An updated evolutionary classification of CRISPR-Cas systems", Nature Reviews Microbiology vol. 13, 2015, pp. 722-736.
Makarova, et al., "Evolution and Classification of the CRISPR-Cas Systems", Nature Reviews Microbiology, vol. 9, No. 6, Jun. 2011, 467-477.
Makarova, et al., "Evolution of Replicative DNA Polymerases in Archaea and their Contributions to the Eukaryotic Replication Machinery", Frontiers in Microbiology, vol. 5, Jul. 2014, pp. 1-10.
Makarova, et al., "Live Virus-Free or Die: Coupling of Antivirus Immunity and Programmed Suicide or Dormancy in Prokaryotes", Biology Direct, vol. 7, No. 40, Jan. 10, 2012.
Makarova, et al., "The basic building blocks and evolution of CRISPR-Cas systems", Biochemical Society Transactions, vol. 41, part 6, 2013, pp. 1392-1400.
Makarova, et al., "Unification of Cas Protein Families and a Simple Scenario for the Origin and Evolution of Crisprcas Systems", Biology Direct, vol. 6, No. 38, 2011, 27 pages.
Makarova, et al., "A putative RNA-interference-based immune system in prokaryotes: computational analysis of the predicted enzymatic machinery, functional analogies with eukaryotic RNAi, and hypothetical mechanisms of action", Biology Direct, vol. 1, Jul. 2006, pp. 1-26.
Miyazaki, et al., "Destabilizing Domains Derived from the Human Estrogen Receptor", Journal of the American Chemical Society, vol. 134, No. 9, 2012, 3942-3945.
Mojica, et al., "Short Motif Sequences Determine the Targets of the Prokaryotic CRISPR Defence System", Microbiology, vol. 155( pt 3), Mar. 2009, 733-740.
Morrell, et al., "Crop Genomics: Advances and Applications", Nature Reviews Genetics, vol. 13, Feb. 2012, 85-96.
Murray, et al., "Suppressors of RNAi from Plant Viruses are Subject to Episodic Positive Selection", Proceedings of The Royal Society B, vol. 280, No. 1765, Jan. 9, 2013.
Nekrasov, et al., "Plant genome editing made easy: targeted mutagenesis in model and crop plants using the CRISPR-Cas system", Plant Methods, 9:39 , 2013, pp. 1-10.
Nelles, et al., "Applications of Cas9 as an RNA-Programmed RNA-Binding Protein", Bioessays, vol. 37, 1-8.
Niewoehner, et al., "Structural Basis for the Endoribonuclease Activity of the Type III—A CRISPR-Associated Protein Cam6", RNA, vol. 22, No. 3, 2016, 318.329.
Nishimasu, et al., "Crystal Structure of Cas9 in Complex with Guide RNA and Target DNA", Cell, vol. 156, No. 5, Feb. 27, 2014, 935-949.
Nishimasu, et al., "Crystal Structure of *Staphylococcus aureus* Cas9", Cell, vol. 162, No. 5, Aug. 27, 2015, 1113-1126.
Nunez, et al., "Integrase-Mediated Spacer Acquisition During CRISPR-Cas Adaptive Immunity", Nature, vol. 519, Mar. 2015, 193-198.
Pasternak, et al., "ISDra2 transposition in Deinococcus radiodurans is downregulated by TnpB", Molecular Microbiology, 88(2), 2013, pp. 443-455.
Peng, et al., "An Archaeal CRISPR Type III-B System Exhibiting Distinctive RNA Targeting Features and Mediating Dual RNA and DNA Interference", Nucleic Acids Research, vol. 43, No. 1, 2014, 406-417.
Peng, et al., "RNA Stabilization by the AU-Rich Element Binding Protein, HuR, an ELAV Protein", The EMBO Journal, vol. 17, No. 12, 1998, 3461-3470.
Petersen, et al., "Towards precisely glyco engineered plants", Plant Biotech Denmark Annual Meeting, Jan. 28-29, 2015, 6 pages.
Platt, et al., "CRISPR-Cas9 Knockin Mice for Genome Editing and Cancer Modelling", Cell, vol. 159, No. 2, Oct. 9, 2014, 440-455.
Price, et al., "Cas9-Mediated Targeting of Viral RNA in Eukaryotic Cells", Proceedings of the National Academy of Sciences , vol. 112, No. 19, May 12, 2015, 6164-6169.
Ramakrishna, et al., "Gene Disruption by Cell-Penetrating Peptide-Mediated Delivery of Cas9 Protein and Guide RNA", Genome Research, vol. 24, No. 6, Jun. 2014, 1020-1027.
Ran, et al., "In Vivo Genome Editing using *Staphylococcus aureau* Cas9", Nature, vol. 520, No. 7546, Apr. 9, 2015, 186-191.
Samai, et al., "Co-transcriptional DNA and RNA cleavage during type III CRISPR-Cas immunity", Cell, vol. 161, No. 5, May 21, 2015, 1164-1174.
Sampson, et al., "A CRISPR-CAS System Mediates Bacterial Innate Immune Evasion and Virulence", Nature, vol. 497, Issue 7448, May 9, 2013, 254-257.
Schunder, et al., "First indication for a functional CRISPR/Cas system in Francisella tularensis", International Journal of Medical Microbiology, 303, 2013, pp. 51-60.
Shalem, et al., "Genome-Scale CRISPR-Cas9 Knockout Screening in Human Cells", Science, vol. 343, No. 6166, Jan. 3, 2014, 84-87.
Shalem, et al., "High-Throughput Functional Genomics Using CRISPR-Cas9", Nature Reviews Genetics, vol. 16, No. 5, May 2015, 299-311.
Shan, et al., "Targeted Genome Modification of Crop Plants Using a CRISPR-Cas System", Nature biotechnology, vol. 31, No. 8, Aug. 2013, 686-688.
Shao, et al., "Structure of the Cmr2-Cmr3 Subcomplex of the Cmr RNA Silencing Complex", vol. 21, Issue 3, Mar. 5, 2013, 376-384.
Sharma, et al., "RNA Interference: A Novel Tool for Plant Disease Management", African Journal of Biotechnology, Academic Journals, vol. 12, No. 18, May 1, 2013, 2303-2312.

(56) References Cited

OTHER PUBLICATIONS

Sheppard, et al., "The CRISPR-Associated Csx1 Protein of Pyrococcus Furiosus is an Adenosine-Specific Endoribonuclease", RNA, vol. 22, No. 2, 2016, 216-224.
Slaymaker, et al., "Rationally Engineered Cas9 Nucleases with Improved Specificity", Science, vol. 351, No. 6268, Jan. 1, 2016, 84-88.
Staals, et al., "RNA Targeting by the Type III—A CRISPR-Cas Csm Complex of Thermus thermophilus", Molecular Cell, vol. 56, Issue 4, Nov. 20, 2014, 518-530.
Stoddard, et al., "Homing Endonuclease Structure and Function", Quarterly Reviews of Biophysics, vol. 38, Issue 1, Feb. 2005, 49-95.
Stovicek, et al., "CRISPR-Cas System Enables Fast and Simple Genome Editing of Industrial *Saccharomyces cerevisiae* Strains", Metabolic Engineering Communications, vol. 2, Dec. 13-22, 2015.
Sugano, et al., "CRISPR/Cas9-Mediated Targeted Mutagenesis in the Liverwort *Marchantia polymorpha* L.", Plant and Cell Physiology, vol. 55, No. 3, 2014, 475-481.
Swart, et al., "The eukaryotic way to defend and edit genomes by sRNA-targeted DNA deletion", Annals of the New York Academy of Sciences, 2015.
Tamulaitis, et al., "Programmable RNA Shredding by the Type III—A CRISPR-Cas System of *Streptococcus thermophilus*", Molecular Cell, vol. 56, No. 4, Nov. 20, 2014, 506-517.
Tsai, et al., "Dimeric CRISPR RNA-Guided FokI Nucleases for Highly Specific Genome Editing", Nature Biotechnology, vol. 32, No. 6, 2014, 569-576.
Vestergaard, et al., "CRISPR adaptive immune systems of Archaea", RNA Biology, 11:2, Feb. 2014, pp. 156-167.
Woo, et al., "DNA-Free Genome Editing in Plants with Preassembled CRISPR-Cas9 Ribonucleoproteins", Nature Biotechnology, vol. 33, No. 11, Nov. 2015, 1162-1164.
Wroblewska, et al., "Mammalian Synthetic Circuits with RNA Binding Proteins for RNA-Only Delivery", Nature Biotechnology, vol. 33, No. 8, Aug. 2015, 839-841.
Xie, et al., "RNA-Guided Genome Editing in Plants Using a CRISPR—Cas System", Molecular Plant, vol. 6, No. 6, Nov. 2013, 1975-1983.
Xing, et al., "A CRISPR/Cas9 Toolkit for Multiplex Genome Editing in Plants", BMC Plant Biology, vol. 14, No. 327, Jan. 12, 2014.
Koonin, E., (Presentation) "Evolution of CRISPR-Cas: the key contribution of transposable elements"; Slide—Class 2 Large Effector Protein Architectures, CRISPR Conference Jun. 20, 2015, 10 pages.

International Search Report dated Nov. 22, 2016, which issued during prosecution of International Application No. PCT/US2016/038258.
International Preliminary Report on Patentability and Written Opinion of the International Searching Authority dated Dec. 19, 2017, which issued during prosecution of International Application No. PCT/US2016/038258.
Abudayyeh, et al. "C2c2 is a single-component programmable RNA-guided RNA-targeting CRISPR effector" Science, 2016, 10.1126/SCIENCE.AAF5573.
Chylinski, et al. "Classification and evolution of type II CRISPR-Cas systems" Nucleic Acids Research, 2014, 42 (10):6091-6105.
Cong, et al. "Multiplex Genome Engineering Using CRISPR/Cas Systems" Science, 2013, 339:819-823.
Hale, et al. "Target RNA capture and cleavage by the Cmr type III-B CRISPR-Cas effector complex" Genes & Development 2014, 28:2432-2443.
Hale, et al. "RNA-Guided RNA Cleavage by a CRISPR RNA-Cas Protein Complex" Cell, 2009, 139:945-956.
Shmakov, et al. "Discovery and Functional Characterization of Diverse Class 2 CRISPR-Cas Systems" Molecular Cell, 2015, 60:385-397.
Database Protein, "Hypothetical protein [Lachnospiraceae bacterium NK4A144]" Jun. 12, 2014, retrieved from NCBI, Database accession No. WP027114339.
Database Protein, Hypothetical protein [Listeria seeligeri], May 18, 2013, retrieved from NBCI, Database accession No. WP012985477.
Database Protein, "Hypothetical protein [Leptotrichia shahii]", Jun. 28, 2013, retrieved from NCBI, Database accession No. WP018451595.
Database Protein, "Hypothetical Protein [Listeria weihenstephanensis]" Dec. 24, 2014, retrieved from NCBI, Database accession No. WP036059185.
Database UniProt, "SubName: Full-Uncharacterized protein" Nov. 13, 2013, retrieved from EBI accession No. UNIPROT:U2PBD1.
Database UniProt, "SubName: Putative phage head-tail adaptor" Nov. 13, 2013, retrieved from EBI accession No. UNIPROT:U2QH90.
The Broad Institute, Inc., et al., "Communication Pursuant to Article 94(3) EPC for EP 16742455.5", dated Oct. 2, 2019, 7 pages.
The Broad Institute, Inc., "Communication pursuant to Article 94(3) EPC for EP 16742455.5", dated Apr. 3, 2020, 6 pages.
The Broad Institute, Inc., "Extended European Search Report for EP 19180795.7", dated May 14, 2020, 14 pages.
The Broad Institute, Inc., "Request for Substantive Examination for Russian Patent Application No. 2018101732/10 (002278)", dated Jan. 31, 2020, 4 pages.
The Broad Institute, Inc., "Communication Pursuant to Article 94(3) EPC for EP 16742455.5", dated Jan. 28, 2021, 4 pages.
The Broad Institute, Inc., "Office Action for Russian Patent Application No. 2018101732/10(002278)", dated Nov. 30, 2020, 8 pages.

\* cited by examiner

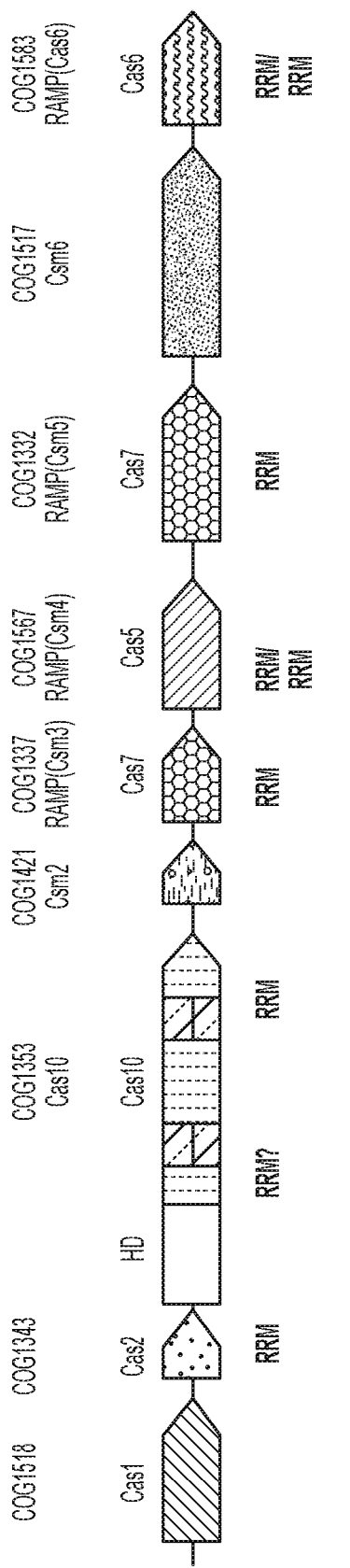
FIG. 4

TYPE II: BACTERIA-SPECIFIC, ~10% BACTERIA
TYPE V: RARE - SEVERAL BACTERIA, ONE ARCHAEON

```
(((((297567845| Meiothermus_silvanus_DSM_9946_uid49485|CAS-I-:0.12931,(
384432243|Thermus_thermophilus_SGO_5JP17_16uid159537|CAS-I-B:0.00887,(
386361517| Thermus_themophilus_JL_18_uid162129|CAS-I-B:0.00343,(
55978407| Thermus_thermophilus_HB8_uid58223|CAS-I-B:0.01080,46255267|Thermus_thermophilus_HB27_uid58033|CAS-I-B0.00015
)0.448:0.0.0372)0.319:0.00572)0.988:0.15812)1.000:0.59771,(
88603116|Methanospirillum_hungatei_JF_1_uid58181|CAS-I-D:0.46421,(
116754851 |Methanosaeta_thermophila_PT_uid58469|part_CAS-I-D:0.18314,(
76802276|Natronomonas_pharaonis_DSM_2160_uid58435|CAS-I-D:0.07809,(
222481446|Halorubrum_lacusprofundi_ATCC_49239_uid58807|CAS-I-D:0.05013,(
385802707|Haloquadratum_walsbyi_C23_uid162019|CAS-I-D:0.05956,
345004201|halophilic_archaeon_DL31_uid72619|CAS-I-D:0.05691)0.592:0.01306)0.968:0.06776)1.000:0.19074)0.946:0.16190
)1.000:0.62110)0.802:0.11633,(344996859|Caldicellulosiruptor_lactoaceticus_6A_uid60575|CAS-I-D:0.74638,
479198757|Synergistetes_bacterium_SGP1_uid197182|part_CAS-III-B:0.87263)0.901:0.15632)0.045:0.02857,(((
170079501|Synechococcus_PCC_7002_uid59137|CAS-I-D:0.08431,(451816690|Synechocystis_PCC_6803_uid189748|CAS-I-D:0.0,
38505684|Synechocystis_PCC_6803_uid57659|CAS-I-D:0.0):0.11618)0.989:0.14433,(((
218245380|Cyanothece_PCC_8801_uid59027|CAS-I-D:0.00350,257058416|Cyanothece_PCC_8802_uid59143|CAS-I_D:0.00015
)0.998:0.11781,(218438692|Cyanothece_PCC_7424_uid59025|CAS-I-D:0.11735,
307591969|Cyanothece_PCC_7822_uid52547|unk_CAS-I-D_CAS-III-B_:0.07806)0.985:0.07995)0.533:0.03328,(
427716556|Calothrix_PCC_7507_uid182930|CAS-I-D:0.11047,((
440685092|Anabaena_cylindrica_PCC_7122_uid183339|CAS-III-D_CAS-I-A:0.14297,
220907870|Cyanothece_PCC_7425_uid59435|CAS-I-D:0.11613)0.951:0.05864,
428314640|Microcoleus_PCC_7113_uid183114|part_unk_CAS-III-A_CAS-III-B_:0.16614)0.950:0.06160)0.971:0.08841)0.791:0.07479
)1.000:058229,(((302391602|Acetohalobium_arabaticum_DSM_5501_uid51423|CAS-I-D:0.44381,(
554636274|Gloeobacter_JS_uid225602|CAS-I-D:0.22797,((((
166365827|Microcystis_aeruginosa_NIES_843_uid59101|CAS-I-D_CAS-I-B:0.20791,
434408292|Stanieria_cyanosphaera_PCC_7437_uid183115|CAS-1-D:0.13929)0.228:0.03671,((((
428216097|Oscillatoria_acuminata_PCC_6304_uid183003|CAS-I-D:0.19792,(
428320277|Oscillatoria_PCC_7112_uid183110|CAS-I-D:0.27889,428311522|Microcoleus_PCC_7113_uid183114|CAS-I-D:0.12589
)0.843:0.05641)0.482:0.04591,((((414079085|Anabaena_90_uid179383|CAS-I-D:0.09782,
440681127|Anabaena_cylindrica_PCC_7122_uid183339|CAS-I-D:0.08465)0.999:0.12236,(
427706868|Nostoc_PCC_7107_uid182932|CAS-I-D:0.03671,427728185|Nostoc_PCC_7524_uid182933|CAS-I-D:0.04621)0.937:0.04305
)0.900:0.03016,428208003|Chroococcidiopsis_thermalis_PCC_7203_uid183002|CAS-I-B:0.08252)0.974:0.06316,(
428775339|Halothece_PCC_7418_uid183338|CAS-III-D_CAS-I-D:0.21969,(
434407100|Cylindrospermum_stagnale_PCC_7417_uid183111|CAS-I-D:0.15065,
186682976|Nostoc_punctiforme_PCC_73102_uid57767|CAS-I-D:0.09799)0.718:0.04465)0.660:0.04261)0.095:0.02408)0.493:0.01908,
434395286|Gloeocapsa_PCC_7428_uid183112|CAS-I-D:0.13065)0.280:0.02533,
428203734|Pleurocapsa_PCC_7327_uid183006|part_CAS-I-D:0.08541)0.586:0.02955)0.850:0.04638,(
428298414|Calothrix_PCC_6303_uid183109|CAS-I-D:0.14796,(427718222|Calothrix_PCC_7507_uid182930|CAS-I-D:0.06596,(
75910374|Anabaena_variabilis_ATCC_29413_uid58043|CAS-I-D:0.00985,17229060|Nostoc_PCC_7120_uid57803|CAS-I-D:0.02003
)1.000:0.09317)0.950:0.05692)0.997:0.12908)0.476:0.07399,428770999 |Cyanobacterium_PCC_10605_uid183340 | CAS-I-B:0.21757
)0.970:0.12653)1.000:0.35184)0.943:0.10056,(258516129 |Desulfotomaculum_acetoxidans_DSM_771_uid59109 |CAS-III-B:0.21196,
134299482 |Desulfotomaculum_reducens_MI_1_uid58277 |CAS-III-A:0.21666)1.000:0.36698)0.880:0.06252,
159898755 |Herpetosiphon_aurantiacus_DSM_785_uid58599 |CAS-I-D:0.64139)0.483:0.05398)0.835:0.07798)0.962:0.10033,((
37677204 |Vibrio_vulnificus_YJ016_uid58007 |CAS-III-D:1.12007,(((((
```

FIG. 10C-1

```
328953422 |Desulfobacca_acetoxidans_DSM_11109_uid65785 |part_unk_CAS-III-A_CAS-I-F_:0.47992,(
218961167 |Candidatus_Cloacamonas_acidaminovorans_Evry_uid62959 |part_CAS-I-F:0.57967,(
313673559 |Caldierrivibrio_nitroreducens_DSM_19672_uid60821 |part_unk_CAS-III-A_CAS-I-F_:0.38694,(
336323599 |Flexistipes_sinusarabici_DSM_4947_uid68147 |part_CAS-III-A:0.00033,
336323857 |Flexistipes_sinusarabici_DSM_4947_uid68147 |CAS-III-B:0.00617)0.963:0.14480)1.000:0.38173)0.969:0.19412
)0.964:0.15382,(116748794 |Syntrophobacter_fumaroidans_MPOB_uid58177 |CAS-III-A:0.76058,(
85858452 |Syntrophus_aciditrophicus_SB_uid58539 |part_unk_CAS-II-C_CAS-V-A_:0.55063,(
333996012 |Treponema_azotonutricium_ZAS_9_uid67365 |CAS-III-B:0.36879,
328949009 |Treponema_succinifaciens_DSM_2489_uid65781 |CAS-III-A:0.32331)1.000:0.47660)0.979:0.20308)0.087:0.06884
)0.593:0.04846,(374339409 |Marinitoga_piezophila_KA3_uid81629 |CAS-III-B:0.65785,
332296542 |Thermodesulfobium_narugense_DSM_14796_uid66601 |CAS-III-A:0.73091)0.843:0.08831)0.951:0.08311,(
337286709 | Thermodesulfatator_indicus_DSM_15286_uid68285 |CAS-III-B:0.59140,
317051217 |Desulfurispirillum_indicum_S5_uid45897 |CAS-III-A:0.77914)0.720:0.11473)0.791:0.06401,(((
671463467 |Clostridium_aminophilum|CAS-VI:0.40052,652829191 |Lachnospiraceae_bacterum_NK4A144 |CAS-VI:0.46794
)1.000:0.55389,((348026605 |Megashaera_elsdenii_DSM_20460_uid71135 |CAS-III-A:0.52920,(
114567264 |Syntrophomonas_wolfei_Goettingen_uid58179 |CAS-III-A:0.49199,
296133514 |Thermincola_potens_JR_uid48823 |CAS-III-A:0.45197)0.211:0.11207)0.727:0.12380,(((
```

FIG. 10C-2

```
494693285| Mycobacterium_tuberculosis_Haarlem3_NITR202_uid202216|part_CAS-III-A:0.06396,(
339632828| Mycobacterium_africanum_GM041182_uid68839|part_CAS-III-A:0.0,
31793993| Mycobacterium_bovis_AF2122_97_uid57695|CAS-III-A:0.0,
378772551| Mycobacterium_bovis_BCG_Mexico_uid86889|CAS-III-A:0.0,
121638696| Mycobacterium_bovis_BCG_Pasteur_1173P2_uid58781|CAS-III-A:0.0,
224991188| Mycobacterium_bovis_BCG_Tokyo_172_uid59281|CAS-III-A:0.0,
340627813| Mycobacterium_canettii_CIPT_140010059_uid70731|CAS-III-A:0.0,
433627935| Mycobacterium_canettii_CIPT_140060008_uid184829|CAS-III-A:0.0,
479315774| Mycobacterium_tuberculosis_Beijing_NITR203_uid197218|part_CAS-III-A:0.0,
494697180| Mycobacterium_tuberculosis_CAS_NITR204_uid202217|CAS-III-A:0.0,
15842358| Mycobacterium_tuberculosis_CDC1551_uid57775|CAS-III-A:0.0,
385999602| Mycobacterium_tuberculosis_CTRI_2_uid161997|CAS-III-A:0.0,
494701250| Mycobacterium_tuberculosis_EAI5_NITR206_uid202218|CAS-III-A:0.0,
471338829| Mycobacterium_tuberculosis_Erdman__ATCC_35801_uid193763|CAS-III-A:0.0,
148824006| Mycobacterium_tuberculosis_F11_uid58417|CAS-III-A:0.0,
148662659| Mycobacterium_tuberculosis_H37Ra_uid58853|CAS-III-A:0.0,
397674731| Mycobacterium_tuberculosis_H37Rv_uid170532|CAS-III-A:0.0,
15609954| Mycobacterium_tuberculosis_H37Rv_uid57777|CAS-III-A:0.0,
197738457| Mycobacterium_tuberculosis_Haarlem_uid54453|CAS-III-A:0.0,
375295366| Mycobacterium_tuberculosis_KZN_4207_uid83619|CAS-III-A:0.0,
392431574| Mycobacterium_tuberculosis_KZN_605_uid54947|CAS-III-A:0.0,
383308570| Mycobacterium_tuberculosis_RGTB327_uid157907|CAS-III-A:0.0,
386005689| Mycobacterium_tuberculosis_RGTB423_uid62179|part_CAS-III-A:0.0,
392387446| Mycobacterium_tuberculosis_UT205_uid162183|CAS-III-A:0.0,
479056780| Mycobacterium_tuberculosis_uid185758|CAS-III-A:0.0,
449064890| Mycobacterium_bovis_BCG_Korea_1168P_uid189029|CAS-III-A:0.0,
525676656| Mycobacterium_tuberculosis_EAI5_uid212307|CAS-III-A:0.0,
253798098| Mycobacterium_tuberculosis_KZN_1435_uid59069|CAS-III-A:0.0):0.00015)1.000:0.72592,(
538369776| Streptococcus_anginosus_C1051_uid218003|part_unk_CAS-II-C_CAS-V-A_:0.28556,(
386344649| Streptococcus_thermophilus_JIM_8232_uid162157|CAS-III-A:0.00014,(
387909738| Streptococcus_thermophilus_MN_ZLW_002_uid166827|CAS-III-A:0.01311,
116627764| Streptococcus_thermophilus_LMD_9_uid58327|part_CAS-III-A:0.00654)0.545:0.00322)0.995:0.31752)1.000:0.60788
)0.990:0.31030)0.648:0.08819)0.953:0.21309,(((554638369|Gloeobacter_JS_uid225602|CAS-III-B:0.61448,(
170079607| Synechococcus_PCC_7002_uid59137|CAS-III-B:0.24207,((((
307592260| Cyanothece_PCC_7822_uid52547|part_unk_CAS-III-A_CAS-I-F_:0.14127,(
451816763| Synechocystis_PCC_6803_uid189748|CAS-III-B:0.0,38505760|Synechocystis_PCC_6803_uid57659|CAS-III-B:0.0):0.33011
)0.755:0.04505,(428771810|Cyanobacterium_PCC_10605_uid183340|CAS-III-B:0.19425,
428772907| Cyanobacterium_stanieri_PCC_7202_uid183337|CAS-III-B:0.23338)0.974:0.08904)0.466:0.02912,(
172035264| Cyanothece_ATCC_51142_uid59013|CAS-III-B:0.13964,(428202534|Pleurocapsa_PCC_7327_uid183006|CAS-III-B:0.13257,
434397028| Stanieria_cyanosphaera_PCC_7437_uid183115|part_CAS-III-B:0.16020)0.941:0.04722)0.197:0.03122)0.890:0.04049,((
428775953| Halothece_PCC_7418_uid183338|CAS-III-B:0.31565,(
440685228| Anabaena_cylindrica_PCC_7122_uid183339|CAS-III-B:0.03157,427726427|Nostoc_PCC_7524_uid182933|CAS-III-B:0.04966
)1.000:0.16057)0.502:0.04473,(428222741|Synechococcus_PCC_7502_uid183008|CAS-III-B:0.22060,((
219883136| Cyanothece_PCC_7425_uid59435|CAS-III-B:0.24737,
86608317| Synechococcus_JA_2_3B_a_2_13_uid58537|CAS-III-B:0.30866)0.910:0.05463,
```

```
427713845|Synechococcus_PCC_6312_uid182934|CAS-III-B:0.31711)0.533:0.01639)0.915:0.05178)0.926:0.05527)0.957:0.09488
)1.000:034564)0.997:0.32519,(119357853|Chlorobium_phaeobacteroides_DSM_266_uid58133|CAS-III-A:0.56109,(
194337466|Pelodictyon_phaeoclathratiforme_BU_1_uid58173|CAS-III-A:0.27006,(
189346458|Chlorobium_limicola_DSM_245_uid58127|CAS-III-C:0.08324,
119357846|Chlorobium_phaeobacteroides_DSM_266_uid58133|CAS-III-A:0.03254)0.991:0.19248)1.000:0.46456)0.838.0.08191
)0.723:0.07502,((427738347|Rivularia_PCC_7116_uid182929|part_unk_CAS-III-A_CAS-I-F_:0.19692,(
428304235|Crinalium_epipsammum_PCC_9333_uid183113|part_unk_CAS-II-C_CAS-V-A_:0.20722,
218442809|Cyanothece_PCC_7424_uid59025|part_unk_CAS-II-C_CAS-V-A_:0.30283)0.494:0.06430)1.000:0.53693,((((
307592471|Cyanothece_PCC_7822_uid52547|CAS-III-B:0.00640,307591462|Cyanothece_PCC_7822_uid52547|CAS-III-B:0.01069
)1.000:0.16903,((17228961|Nostoc_PCC_7120_uid57803|CAS-III-D:0.11751,(
427717966|Calothrix_PCC_7507_uid182930|CAS-III-D:0.12306,427708216|Nostoc_PCC_7107_uid182932|CAS-III-D:0.09142
)0.303:0.02829)0.352:0.02253,(428297029| Calothrix_PCC_6303_uid183109|part_unk_CAS-II-C_CAS-V-A_:0.14591,
440685177|Anabaena_cylindrica_PCC_7122_uid183339|CAS-III-B:0.15470)0.653:0.02803)0.986:0.07325)0.885:0.03354,(
428314604|Microcoleus_PCC_7113_uid183114|CAS-III-D:0.12998,
479129286|Arthrospira_platensis_NIES_39_uid197171|part_unk_CAS-II-C_CAS-V-A_:0.33218)0.938:0.06077)0.868:0.07146,(
428314605|Microcoleus_PCC_7113_uid183114|CAS-III-D:0.36693,(
440685178|Anabaena_cylindrica_PCC_7122_uid183339|CAS-III-B:0.17441,(
428297030|Calothrix_PCC_6303_uid183109|part_unk_CAS-II-C_CAS-V-A_:0.24751,(
427717963|Calothrix_PCC_7507_uid182930|CAS-III-D:0.09450,427708213|Nostoc_PCC_7107_uid182932|CAS-III-D:0.08533
)0.952:0.07939)0.848:0.06617)1.000:0.71310)0.991:0.22885)1.000:0.40660)0.912:0.12054)0.922:0.09536)0.959:0.10256
)0.169:0.06953)0.245:0.02881,((159898907|Herpetosiphon_aurantiacus_DSM_785_uid58599|part_unk_CAS-III-A_CAS-I-F_:0.46903,
((222526872|Chloroflexus_Y_400_fl_uid59085|part_CAS-III:0.0,
163848915|Chloroflexus_aurantiacus_J_10_fl_uid57657|part_CAS-III:0.0):0.24442,(
```

FIG. 10D-2

```
148657121| Roseiflexus_RS_1_uid58523|part_unk_CAS-III-A_CAS-I-F_:0.08582,
156742636| Roseiflexus_castenholzii_DSM_13941_uid58287|part_unk_CAS-III-A_CAS-I-F_:0.07937)0.998:0.23498)0.999:0.33337
)0.998:0.29757,(((220910738| Cyanothece_PCC_7425_uid59435| part_CAS-III-D:0.25196,((
428769331| Cyanobacterium_PCC_10605_uid183340|part_unk_CAS-III-A_CAS-I-F_:0.23405,(
451816742| Synechocystis_PCC_6803_uid189748|CAS-III-D:0.0,38505739| Synechocystis_PCC_6803_uid57659|CAS-III-D:0.0):0.30820
)0547:0.05850,17227877|Nostoc_PCC_7120_uid57803|part_unk_CAS-III-A_CAS-I-F_:0.13712)0.130:0.03952)0.684:0.0.06959,
479129959| Arthrospira_platensis_NIES_39_uid197171|CAS-III-D:0.18655)1.000:0.67920,(
383762167| Caldilinea_aerophila_DSM_14535__NBRC_104270_uid158165|CAS-III-A:0.50262,(
320161859| Anaerolinea_thermophila_UNI_1_uid62245|CAS-III-A:0.61291,(
159899002| Herpetosiphon_aurantiacus_DSM_785_uid58599|CAS-III-A:0.28369,(
156741961| Roseiflexus_castenholzii_DSM_13941_uid58287|CAS-III-A:0.18838,((
222523888|Chloroflexus_Y_400_fl_uid59085| CAS-III-A:0.0,163846146 |Chloroflexus_aurantiacus_J_10_fl_uid57657|CAS-III-A:0.0
):0.09089,219850296 | Chloroflexus_aggregans_DSM_9485_uid58621|CAS-III-A:0.07901)1.000:0.17642)0.480:0.07447)0.977:0.14597
)0.092:0.10988)0.974:0.17638)0.157:0.08519)0.942:0.07818)0.912:0.05168,(((((
336116789| Microlunatus_phosphovorus_NM_1_uid68055|CAS-III-D_CAS-III-D:0.88741,((
384439730| Thermus_CCB_US3_UF1_uid81197|CAS-III-A:0.13882,55978328 |Thermus_thermophilus_HB8_uid58223|CAS-III-A:0.15950
)0.990:0.16073,(((482881777 | Meiothermus_ruber_DSM_1279_uid198526| CAS-III-A:0.0,
291294626| Meiothermus_ruber_DSM_1279_uid46661| CAS-III-A:0.0):0.09787,
297565159| Meiothermus_silvanus_DSM_9946_uid49485|CAS-III-A:0.10224)0.999:0.24700,
297622675| Truepera_radiovictrix_DSM_17093_uid49533|part_CAS-III-:0.53343)0.265:0.04315)0.999:0.38560)0.964:0.22004,(
268318378| Rhodothermus_marinus_DSM_4252_uid41729|part_CAS-III-:0.00343,
345301858| Rhodothermus_marinus_SGO_5JP17_172_uid72767|part_CAS-III-:0.00014)1.000:0.51565)0.658:0.09418,
20094748| Methanopyrus_kandleri_AV19_uid57883|CAS-III-A:1.27255)0.915:0.11597,(((
209966743| Rhodospirillum_centenum_SW_uid58805|CAS-III-B:0.10369,(
83592490| Rhodospirillum_rubrum_ATCC_11170_uid57655|part_CAS-III-D:0.0,
386349209| Rhodospirillum_rubrum_F11_uid162149| part_CAS-III-D:0.0):0.18242)1.000:0.82857,(((((
295697238| Kyrpidia_tusciae_DSM_2912_uid48361|CAS-I-U:0.32597,(
258512610|Alicyclobacillus_acidocaldarius_DSM_446_uid59199|CAS-I-U:0.11313,
384136648|Alicyclobacillus_acidocaldarius_Tc_4_1_uid158681|CAS-I-U:0.05298)1.000:0.34237)0.989:0.15396,(((
83589357|Moorella_thermoacetica_ATCC_39073_uid58051|CAS-I-C:0.31898,((
114331015|Nitrosomonas_eutropha_C91_uid58363|part_CAS-I-C:0.15561,((
56477284|Aromatoleum_aromaticum_EbN1_uid58231|CAS-I-C:0.14230,(
89902666| Rhodoferax_ferrireducens_T118_uid58353|CAS-I-C:0.17498,
171057839|Leptothrix_cholodnii_SP_6_uid58971|CAS-I-C:0.11170)0.814:0.04976)0.999:0.12856,
261855429| Halothiobacillus_neapolitanus_c2_uid41317|CAS-I-C:0.23592)0.304:0.04714)0.993:0.13967,(
292492002|Nitrosococcus_halophilus_Nc4_uid46803|CAS-I-C:0.19704,(
53804988|Methylococcus_capsulatus_Bath_uid57607|CAS-I-C:0.12382,
357404710|Methylomicrobium_alcaliphilum_uid77119|CAS-I-C:0.19288)1.000:0.18583)0.936:0.08848)0.979:0.09732
)0.204:0.04688,(222056492 |Geobacter_FRC_32_uid58543|CAS-I-C:0.14622,
404495934|Geobacter_metallireducens_GS_15_uid57731|CAS-I-C:0.12478)1.000:0.21818)0.776:0.05937,((
328949815|Marinithermus_hydrothermalis_DSM_14884_uid65783|CAS-I-C:0.37258,(
384432300|Thermus_thermophilus_SGO_5JP17_16_uid159537|CAS-I-C:0.17877,((
482884640| Meiothermus_ruber_DSM_1279_uid198526|CAS-III-C_CAS-III-B:0.0,
291295861| Meiothermus_ruber_DSM_1279_uid46661|CAS-III-B_CAS-I-C:0.0):0.06310,
297567720| Meiothermus_silvanus_DSM_9946_uid49485|CAS-III-B_CAS-III-I-C:0.05240)1.000:0.20363)0.963:0.10592)0.941:0.06853,(
```

FIG. 10E-1

```
297623899|Truepera_radiovictrix_DSM_17093_uid49533|CAS-I-C_CAS-III-B:0.19260,(
94984342|Deinococcus_geothermalis_DSM_11300_uid58275|CAS-I-C:0.46473,(
434386050|Chamaesiphon_PCC_6605_uid183005|CAS-I-C:0.22289,428217990|Pseudanabaena_PCC_7367_uid183004|CAS-I-C:0.19947
)0.888:0.06148)0.958:0.08713)0.905:0.05144)0.946:0.06575)0.979:0.08730)0.912:0.06733,((((
209543797|Gluconacetobacter_diazotrophicus_PAl_5_uid59075|CAS-I-C:0.00340,
162145897|Gluconacetobacter_diazotrophicus_PAl_5_uid65187|CAS-I-C:0.00014)1.000:0.18549,(
304321090|Parvularcula_bermudensis_HTCC2503_uid51641|CAS-I-C:0.16338,
347528128|Sphingobium_SYK_6_uid73353|CAS-I-C:0.09663)0.948:0.09681)1.000:0.17457,(((((
310816367|Ketogulonicigenium_vulgare_Y25_uid59581|CAS-I-C:0.11062,(
294676849|Rhodobacter_capsulatus_SB_1003_uid47509|CAS-I-C:0.05819,
221640061|Rhodobacter_sphaeroides_KD131_uid59277|CAS-I-C:0.08595)0.970:0.05945)0.980:0.07542,(((
83592169|Rhodospirillum_rubrum_ATCC_11170_uid57655|CAS-I-C:0.0,386348878|Rhodospirillum_rubrum_F11_uid162149|CAS-I-C:0.0
):0.18656,(312113992|Rhodomicrobium_vannielii_ATCC_17100_uid43247|CAS-I-C:0.10787,(
563687395|Hyphomicrobium_nitrativorans_NL23_uid230615|CAS-I-C:0.12070,
316934446|Rhodopseudomonas_palustris_DX_1_uid43327|part_CAS-I-C:0.10709)1.000:0.09221)0.778:0.03117)0.884:0.03668,
75676127|Nitrobacter_winogradskyi_Nb_255_uid58295|CAS-I-C:0.10031)0.871:0.05400)0.880:0.04848,(
260738831|Zymomonas_mobilis_NCIMB_11163_uid41019|CAS-I-C:0.01054,
338708688|Zymomonas_mobilis_pomaceae_ATCC_29192_uid68445|CAS-I-C:0.02859)1.000:0.15499)0.995:0.13218,
389874620|Tistrella_mobilis_KA081020_065_uid167486|CAS-I-C:0.33986)0.963:0.07738,((
34496684|Chromobacterium_violaceum_ATCC_12472_uid58001|CAS-I-C:0.14153,((((
146284062|Pseudomonas_stutzeri_A1501_uid58641|CAS-I-C:0.14333,(
482897694|Azotobacter_vinelandii_CA6_uid198830|CAS-I-C:0.0,482893362|Azotobacter_vinelandii_CA_uid198829|CAS-I-C:0.0
226945223|Azotobacter_vinelandii_DJ_uid57597|CAS-I-C:0.0):0.10321)0.856:0.02265,
```

FIG. 10E-2

```
326318659|Acidovorax_avenae_ATCC_19860_uid42497|CAS-I-C:0.14475)0.275:0.02588,(
357418717| Pseudoxanthomonas_spadix_BD_a59_uid75113|CAS-I-C:0.03905,(
285019651|Xanthomonas_albilineans_GPE_PC73_uid43163|CAS-I-C:0.01394,((
58580490|Xanthomonas_oryzae_KACC_10331_uid58155|CAS-I-C:0.0,
84622450|Xanthomonas_oryzae_MAFF_311018_uid58547|CAS-I-C:0.0,188578573|Xanthomonas_oryzae_PXO99A_uid59131|CAS-I-C:0.0
):0.03952,((470473692 |Xanthomonas_axonopodis_Xac29_1_uid193774 |part_CAS-I-C:0.0,
21244566|Xanthomonas_axonopodis_citri_306_uid57889|CAS-I-C:0.0):0.00014,
471270099|Xanthomonas_citri_Aw12879_uid194444|CAS-I-C:0.00344)0.998:0.04712)0.842:0.00670)0.829:0.01507)1.000:0.11447
)0.917:0.03431,337281134 |Ramlibacter_tataouinensis_TTB310_uid68279|CAS-I-C:0.15676)0.985:0.08157)0.968:0.07387,(
357405511| Methylomicrobium_alcaliphilum_uid77119|CAS-I-C:0.02227,(325982105|Nitrosomonas_AL212_uid55727|CAS-I-C:0.11807,
333984705|Methylomonas_methanica_MC09_uid67363|CAS-I-C:0.07175)0.314:0.01846)1.000:0.41968)0.848:0.04118)0.901:0.04661
)0.969:0.07817,(((((83645586|Hahella_chejuenisis_KCTC_2396_uid58483|CAS-I-C:0.21560,(
192359205|Cellvibrio_japonicus_Ueda107_uid59139|CAS-I-C:0.11441,(
473829590|Thalassolituus_oleivorans_MIL_1_uid195604|CAS-I-C:0.20597,
91774961|Methylobacillus_flagellatus_KT_uid58049|CAS-I-C:0.21230)0.347:0.04252)0.995:0.12412)0.898:0.06588,(
254787056|Teredinibacter_turnerae_T7901_uid59267|CAS-I-C:0.31997,(
307130364|Dickeya_dadantii_3937_uid52537|CAS-I-C:0.32627,(
397661233|Taylorella_equigenitalis_ATCC_35865_uid170255|CAS-I-C:0.39846,((
365967615|Aggregatibacter_actinomycetemcomitans_ANH9381_uid80743|part_CAS-I-C:0.00707,
387120005|Aggregatibacter_actinomycetemcomitans_D7S_1_uid46989|CAS-I-C:0.00014)0.945:0.04167,(((
52425036|Mannheimia_succiniciproducens_MBEL55E_uid58197|CAS-I-C:0.05112,(
470167394|Bibersteinia_trehalosi_192_uid193709|CAS-I-C:0.05693,((
525701705|Mannheimia_haemolytica_D153_uid212303|CAS-I-C:0.0,525663030| Mannheimia_haemolytica_D174_uid212305|CAS-I-C:0.0,
482886282|Mannheimia_haemolytica_M42548_uid198769|CAS-I-C:0.0,
472336761|Mannheimia_haemolytica_USDA_ARS_SAM_185_uid195457|CAS-I-C:0.0,
472333878| Mannheimia_haemolytica_USDA_ARS_USMARC_183_uid195458|CAS-I-C:0.0,
526468419| Mannheimia_haemolytica_USMARC_2286_uid213228|CAS-I-C:0.0):0.01291,
525656088| Mannheimia_haemolytica_D171_uid212304|CAS-I-C:0.01842)0.948:0.02900)0.808:0.02266)0.832:0.01178,(
152978958|Actinobacillus_succinogenes_1307_uid58247|CAS-I-C:0.05445,
313668836|Neisseria_lactamica_020_06_uid60851| part_CAS-I-C:0.04725)0.252:0.01699)0.817:0.02509,
251792131|Aggregatibacter_aphrophius_NJ8700_uid59407|CAS-I-C:0.03458)0.925:0.03833)0.996:0.15000)0.698:0.06342
)0.458:0.03229)0.995:0.10686)0.999:0.19085,((117926798|Magnetococcus_MC_1_uid57833|CAS-I-C:0.47940,(
383765764|Phycisphaera_mikurensis_NBRC_102666_uid157331|CAS-I-C:0.30160,(
325110400| Planctomyces_brasilensis_DSM_5305_uid60583|CAS-I-C:0.0,
325110641| Planctomyces_brasilensis_DSM_5305_uid60583|CAS-I-C:0.0):0.29948)0.948:0.10809)0.942:0.07726,(((
225872438|Acidobacterium_capsulatum_ATCC_51196_uid59127|CAS-I-C:0.40460,((((
339500527|Spirochaeta_caldaria_DSM_7334_uid68753|CAS-I-C:0.27940,(
320160633|Anaerolinea_thermophila_UNI_1_uid62245|CAS-I-C:0.13868,148658413|Roseiflexus_RS_1_uid58523|CAS-I-C:0.19466
)0.966:0.09469)0.997:0.14213,(347532818|Roseburia_hominis_A2_183_uid73419|CAS-I-C:0.37008,((((
348026839|Megasphaera_elsdenii_DSM_20460_uid71135|part_CAS-I-C:0.30817,(
284048123|Acidaminococcus_fermentans_DSM_20731_uid43471|CAS-I-C:0.36107,
330839805|Selenomonas_sputigena_ATCC_35185_uid55329|CAS-I-C:0.26595)0.463:0.07631)0.629:0.06598,(
257791721|Eggerthella_lenta_DSM_2243_uid59079|CAS-I-C:0.34354,((
470202636|Bifidobacterium_thermophilum_RBL67_uid193770|CAS-I-C:0.21294,((
384197500|Bifidobacterium_breve_ACS_071_V_Sch8b_uid158863|part_CAS-I-C:0.0,
```

FIG. 10F-1

476418506|Bifidobacterium_breve_UCC2003_uid193702|CAS-I-C:0.0):0.12950,(
119026198|Bifidobacterium_adolescentis_ATCC_15703_uid58559|CAS-I-C:0.15387,
283456492|Bifidobacterium_dentium_Bd1_uid43091|part_CAS-I-C:0.15297)0.981:0.09256)0.816:0.06794)1.000:0.24455,
479209860|Faecalibacterium_prausnitzii_L2_6_uid197183|CAS-I-C:0.25569)0.794:0.04916)0.929:0.07086)0.963:0.06498,((
479212266| Eubacterium_siraeum_V10Sc8a_uid197178|CAS-I-C:0.27163,317055826|Ruminococcus_albus_7_uid51721|CAS-I-C:-.22674
)0.997:0.16362,(((332687143|Melissococcus_plutonius_ATCC_35311_uid66803|CAS-I-C:0.01152,
379726963| Melissococcus_plutonius_DAT561_uid89371|CAS-I-C:0.00014)1.000:029966,((
385812491|Lactobacillus_fermentum_CECT_5716_uid162003|CAS-I-C:0.0,
184155685|Lactobacillus_fermentum_IFO_3956_uid58865|CAS-I-C:0.0):0.29235,(
161507871|Lactobacillus_helveticus_DPC_4571_uid58761|CAS-I-C:0.00014,(
385813367|Lactobacillus_helveticus_H10_uid162017|CAS-I-C:0.00014,
403514602|Lactobacillus_helveticus_R0052_uid174439|CAS-I-C:0.00333)0.840:0.00330)0.999:016959)1.000:0.23135
)0.499:0.03263,((56965354 |Bacillus_clausii_KSM_K16_uid58237|CAS-I-C:0.05166,
15612904|Bacillus_halodurans_C_125_uid57791|CAS-III-B_CAS-I-C:0.04633)0.999:0.12452,(
172056196|Exiguobacterium_sibiricum_255_15_uid58053|CAS-I-C:0.22966,
374323589|Paenibacillus_terrae_HPL_003uid82371|CAS-I-C_CAS-III-B:0.23841)0.495:0.04314)0.981:0.09784)0.251:0.07083
)0.240:0.04721)0.509:0.04808,((479153813 |Ruminococcus_uid197156|CAS-I-C:0.11602,((
238924839|Eubacterium_rectale_ATCC_33656_uid59169|CAS-I-C:0.0,479142552|Eubacterium_rectale_uid197161|CAS-I-C:0.0
):0.00358,479214255|Eubacterium_rectale_uid197162|CAS-I-C:0.00805)1.000:0.14214)1.000:0.20907,(
317131634|Ethanoligenens_harbinense_YUAN_3_uid46255|CAS-I-C:0.22533,((
376260588|Clostridium_BNL1100_uid84307|CAS-I-C:0.02134,
220928906|Clostridium_cellulolyticum_H10_uid58709|part_CAS-I-C:0.03577)0.996:0.09301,(
150389454|Alkaliphilus_metalliredigens_QYMF_uid58171|CAS-I-C:0.06931,((

FIG. 10F-2

```
392424830|Desulfosporosinus_acidiphilus_SJ4_uid156759|CAS-I-C:0.0175,
258516757|Desulfotomaculum_acetoxidans_DSM_771_uid59109|CAS-I-C:0.04290)0.888:0.02426,(
334339986|Desulfotomaculum_ruminis_DSM_2154_uid67507|CAS-I-C:0.01929,(
374994461|Desulfosporosinus_orientis_DSM_765_uid82939|CAS-I-C:0.04810,
219668223|Desulfitobacterium_hafniense_DCB_2_uid57749|CAS-I-C:0.03608)0.906:0.01877)0.925:0.02160)0.996:0.08427
)0.955:0.06361)0.979:0.07839)0.923:0.06196)0.344:0.02993)0.327:0.02993)0.782:0.05756)0.925:0.06604,((
124485674|Methanocorpusculum_labreanum_Z_uid58785|CAS-I-C:0.28665,(
347542431|Candidatus_Arthromitus_SFB_rat_Yit_uid73425|CAS-I-C:0.05275(
342732369|Candidatus_Arthromitus_SFB_mouse_Japan_uid71379|CAS-I-C:0.00357,
384455776|Candidatus_Arthromitus_SFB_mouse_Yit_uid159517|CAS-I-C:0.00401)0.983:0.07788)1.000:0.25809)0.994:0.14695,((
332300108|Porphyromonas_asaccharolytica_DSM_20707_uid6603|CAS-I-C:0.39043,(
319902868|Bacteroides_helcogenes_P_36_108_uid62135|CAS-I-C:0.03580,
150007825|Parabacteroides_distasonis_ATCC_8503_uid58301|CAS-I-C:0.04460)1.000:0.28943)0.987:0.16824,(((
374307349|Filifactor_alocis_ATCC_35896_uid46625|CAS-IC:0.33336,(((
414563500|Streptococcus_equi_zooepidemicus_ATCC_35246_uid162155|CAS-I-C:0.00414,(
195977694|Streptococcus_equi_zooepidemicus_MGCS10565_uid59263|CAS-I-C:0.01035,
225869002|Streptococcus_equi_zooepidemicus_uid59261|CAS-I-C:0.00344)0.715:0.00277)0.997:0.05032,(((
94992802|Streptococcus_pyogenes_MGAS2096_uid85873|CAS-I-C:0.0,
94988910|Streptococcus_pyogenes_MGSA9429_uid58569|CAS-I-C:0.0)0.00014,((
410680951|Streptococcus_pyogenes_A20_uid178106|CAS-I-C:0.0,
470201448|Streptococcus_pyogenes_M1_476_uid193766|CAS-I-C:0.0,
15675454|Streptococcus_pyogenes_M1_GAS_uid57845|CAS-I-C:0.0,
71911099|Streptococcus_pyogenes_MGAS5005_uid58337|CAS-I-C:0.0,
209559719|Streptococcus_pyogenes_NZ131_uid59035|CAS-I-C:0.0)0.00341,(
94994789|Streptococcus_pyogenes_MGAS10750_uid58575|CAS-I-C:0.0,
71903952|Streptococcus_pyogenes_MGAS5180_uid58335|CAS-I-C:0.0):0.00678)0.000:0.00014)0.745:0.00016,((
386317483|Streptococcus_dysgalactiae_equisimilis_ATCC_12394_uid161979|CAS-I-C:0.0,
408402093|Streptococcus_dysgalactiae_equismilis_RE378_uid176684|CAS-I-C:0.0):0.00016,
410495372|Streptococcus_dysgalactiae_equisimilis_AC_2713_uid178644|CAS-I-C:0.01034)0.821:0.00343)0.974:0.03965
)0.899:0.03735,((488650818|Streptococcus_oligofermentans_AS_1_3089_uid201429|part_CAS-I-C:0.03053,
337281888|Streptococcus_parasanguinis_ATCC_15912_uid49313|CAS-I-C:0.06356)0.488:0.01131,(
387785565|Streptococcus_mutans_L123_uid162197|CAS-I-C:0.04809,(
512544178|Streptococcus_agalactiae_ILRI005_uid208676 |CAS-I-C:0.00338,
512697896|Streptococcus_agalactiae_ILRI112_uid208675 |part_CAS-I-C:0.00016)1.000: 0.10085)0.818 :0.02123)0.955 :0.05838
)1.000 :0.36861)0.814 :0.08762,479200819 |Ruminococcus_champanellensis_18P13_uid197169|CAS-I-C:0.70869)0.387:0.08932,
432332081 |Methanoregula_formicicum_SMSP_uid184406|CAS-I-C:0.26538)0.055:0.04596)0.901 :0.06571)0.797:0.04883
) 0.815:0.05584,((333922763 |Desulfotomaculum_carboxydivorans_CO_1_SRB_uid57317|CAS-I-C:0.17157,(
296133388 |Thermincola_potens_JR_uid46823|CAS-I-C:0.11819,(
488777678 |Desulfotomaculum_gibsoniae_DSM_7213_uid76945|CAS-I-C:0.10279,
134298871 |Desulfotomaculum_reducens_MI_1_uid58277|CAS-I-C:0.04530)1.000: 0.15000)0.999:0.18200) 0.496:0.05453,(
114566032 |Syntrophomonas_wolfei_Goettingen_uid58179|CAS-I-C:0.30082,
325289071 |Syntrophobotulus_glycolicus_DSM_8271_uid63343|CAS-I-C:0.32214)0.878:0.08385)0.751:0.03214 )0.993:0.11421
) 0.341:0.03208,(((( 320353599|Desulfobulbus_propionicus_DSM_2032_uid62265|CAS-I-C:0.21317,
451949099 |Desulfocapsa_sulfexigens_DSM_10523_uid189952|CAS-I-C:0.22645)0.979:0.09739,
239906078 |Desulfovibrio_magneticus_RS_1_uid59309|CAS-I-C:0.30964)0.143:0.01092,((
```

FIG. 10G-1

376297899 |Desulfovibrio_desulfuticans_ND132_uid53159|CAS-I-C:0.27386,(
120586827 |Desulfovibrio_vulgaris_DP4_uid58679|CAS-I-C:0.00479,(
46562259 |Desulfovibrio_vulgaris_Hidenborough_uid57645|CAS-I-C:0.0,
387134024 |Desulfovibrio_vulgaris_RCH1_uid161961|CAS-I-C:0.0):0.00565)1.000:0.21839 )0.957:0.08711,
85860584 |Syntrophus_aciditrophicus_SB_uid58539|CAS-I-C:0.20754)0.933:0.05698)0.926:0.03722, (((
374317440 |Sphaerochaeta_pleomorpha_Grapes_uid82365|CAS-I-C:0.24593,
189485223 |uncultured_Termite_group_1_bacterium_phylotype_Rs_D17_uid59059|CAS-I-C_CAS-II-C:0.35534)0.374:0.07775,
302337595 |Spirochaeta_smaragdinae_DSM_11293_uid51369|CAS-I-C:0.46591)0.738:0.08136,((
332298797 |Treponema_brennaborense_DSM_12168_uid66607|CAS-I-C:0.32520,(
307718095 |Spirochaeta_thermophila_DSM_6912_uid53037|part_CAS-I-C:0.01444,
386346101 |Spirochaeta_thermophila_DSM_6578_uid162041|part_CAS-I-C:0.02449)1.000:0.38635)0.148:0.07924,(((
78187160 |Chloronium_luteolum_DSM_273_uid58175|CAS-I-C:0.02337,
119357239 |Chlorobium_phaeobacteroides_DSM_266_uid58133|CAS-I-C:0.01186)0.998:0.06955,(
145220110 |Chlorobium_phaeovibrioides_DSM_265_uid58129|CAS-I-C:0.13787,
21673956 |Chlorobium_tepidum_TLS_uid57897|CAS-I-C:0.12469)0.690:0.02637)0.853: 0.03296,(
194336722 |Pelodictyon_phaeoclathratiforme_BU_1_uid58173|CAS-I-C:0.04883,
78188972 |Chlorobium_chorochromarii_CaD3_uid58375|CAS-I-C:0.13949 )0.740:0.02584)1.000 :0.24177)0.857:0.06790
)0.786:0.02623 )0.907:0.03281 )0.806:0.04037, ((392409180|Desulfomonile_tiedjei_DSM_6799_uid168320|CAS-I-C:0.36970,
297617712 |Syntrophothermus_lipocalidus_DSM_12680_uid49527|CAS-|-C:0.20635)0.257:0.04914,
452202942 |Dehalococcoides_mccartyi_DCMB5_uid190184|CAS-I-C:0.49114)0.513:0.04271)0.951:0.06009)0.709:0.01540
)0.214:0.03491, 302343095 |Desulfarculus_baarsii_DSM_2075_uid51371|CAS-I-C:0.43957)0.070:0.02646,
218887066 |Desulfovibrio_vulgaris__Miyazaki_F_uid59089|CAS-I-C:0.35608)0.890:0.04878)0.988:0.11736)0.423:0.06779,(
442324547 |Myxococcus_stipitatus_DSM_14675_uid186549|CAS-I-C:0.08918,(

FIG. 10G-2

```
338531918|Myxococcus_fulvus_HW_1_uid68443|CAS-I-C:0.03767,108763792|Myxococcus_xanthus_DK_1622_uid58003|CAS-I-C:0.03256
)0.985:0.08382)1.000:0.35877)0.815:0.10155,(86742032|Frankia_CcI3_uid58397|CAS-I-C:0.62394,
433631663|Mycobacterium_canettii_CIPT_140070010_uid184828|CAS-I-C:0.55622)0.903:0.17757)0.984:0.19926)0.918:0.14978,(((
571027519|Thermosynechococcus_NK55_uid231517|part_CAS-I-B:0.24831,(
427712290|Synechococcus_PCC_6312_uid182934|CAS-I-B:0.15168,(((170078384|Synechococcus_PCC_7002_uid59137|CAS-I-B:0.18175,(
(218442585|Cyanothece_PCC_7424_uid59025|CAS-I-B:0.06629,434393783|Gloeocapsa_PCC_7428_uid183112|CAS-I-B:0.08146
)0.413:0.00860,(172036113|Cyanothece_ATCC_51142_uid59013|CAS-I-B:0.05728,
428774573|Cyanobacterium_stanieri_PCC_7202_uid183337|CAS-I-B:0.16876)0.321:0.03432)0.984:0.07499)0.914:0.04640,
434399186|Stanieria_cyanosphaera_PCC_7437_uid183115|CAS-I-B:0.16867)0.061:0.04161)0.868:0.06959)0.999:0.24474,((
347756303|Candidatus_Chloracidobacterium_thermophilum_B_uid73587|CAS-I-B:0.36997,(
442324860|Myxococcus_stipitatus_DSM_14675_uid186549|CAS-I-B_CAS-III-B:0.09689,
108761389|Myxococcus_xanthus_DK_1622_uid58003|CAS-I-B:0.06599)1.000:0.36129)0.910:0.09531,(
162457462|Sorangium_cellulosum__So_ce_56__uid61629|CAS-I-B:0.42099,(
294101137|Aminobacterium_colombiense_DSM_12261_uid47083|CAS-I-B:0.39876,(
430741373|Singulisphaera_acidiphila_DSM_18658_uid81777|CAS-I-B:0.36511,((
294828260|Leptospira_interrogans_serovar_Lai_56601_uid57881|CAS-I-B:0.0,
386075004|Leptospira_interrogans_serovar_Lai_IPAV_uid161957|CAS-I-B:0.0):0.00015,
45656830|Leptospira_interrogans_serovar_Copenhageni_Fiocruz_L1_130_uid58065|CAS-I-B:0.00014)1.000:0.42562)0.843:0.10438
)0.898:0.12673)0.637:0.06018)0.915:0.08471)1.000:0.57872,(((
241196732|Bifidobacterium_animalis_lactis_DSM_10140_uid59357|part_CAS-I-U:0.0
384189957|Bifidobacterium_animalis_lactis_BB_12_uid158871|part_CAS-I-U:0.0,
387822880|Bifidobacterium_animalis_lactis_Bi_07_uid163693|part_CAS-I-U:0.0,
384192748|Bifidobacterium_animalis_lactis_CNCM_I_2494_uid158869|part_CAS-I-U:0.0,
219683006|Bifidobacterium_animalis_lactis_AD011_uid58911|part_CAS-I-U:0.0,
452892254|Bifidobacterium_animalis_lactis_BLC1_uid158867|part_CAS-I-U:0.0,
518657695|Bifidobacterium_animalis_lactis_Bl12_uid210081|part_CAS-I-U:0.0,
387821196|Bifidobacterium_animalis_lactis_B420_uid163691|part_CAS-I-U:0.0,
241191326|Bifidobacterium_animalis_lactis_Bl_04_uid59359|part_CAS-I-U:0.0,
384195888|Bifidobacterium_animalis_lactis_V9_uid158865|part_CAS-I-U:0.0):0.42978,(
297625585|Propionibacterium_freudenreichii_shermanii_CIRM_BIA1_uid49535|part_CAS-I-U:0.50977,(
283458258|Rothia_mucilaginosa_uid43093|part_CAS-I-U:0.21999,(
384514652|Corynebacterium_ulcerans_809_uid159659|part_CAS-I-U:0.00015,(
337289723|Corynebacterium_ulcerans_BR_AD22_uid68291|part_CAS-I-U:0.00016,
397652857|Corynebacterium_ulcerans_0102_uid169879|part_CAS-I-U:0.00334)0.758:0.00659)1.000:0.37542)0.978:0.16541
)0.863:0.10118)1.000:0.64061,(763429367|Opitutaceae_bacterium_TAV5|CAS-V-B:0.69846,(((
736635901|Desulfovibrio_inopinatus|CAS-V-B:0.59579,((737508624|Alicyclobacillus_contaminans|CAS-V-B:0.25367,
529046751|Alicyclobacillus_acidoterrestris_ATCC_49025|CAS-V-B:0.19235)0.976:0.12626,((
737334744|Brevibacillus_sp__CF112|CAS-V-B:0.0,651512540|Bacillus_sp__NSP2_1|CAS-V-B:0.0):0.31952,(
754485391|Bacillus_thermoamylovorans|CAS-V-B:0.22077,654153033|Tuberibacillus_calidus|CAS-V-B:0.14587)0.988:0.12626
)0.977:0.15585)0.991:0.19243)0.993:0.18899,(312114617|Rhodomicrobium_vannielii_ATCC_17100_uid43247|CAS-III-D:1.06692,((
83591519|Rhodospirillum_rubrum_ATCC_11170_uid57655|CAS-I-E_CAS-III-D:0.0,
386348198|Rhodospirillum_rubrum_F11_uid162149|CAS-I-E_CAS-III-D:0.0):0.23452,(
```

FIG. 10H-1

```
288959585|Azospirillum_B510_uid46085|CAS-I-U:0.05573,374292449|Azospirillum_lipoferum_4B_uid82343|CAS-I-U:0.07857
}0.999:0.20501}0.999:0.35579}0.713:0.05291}0.817:0.02983,(((((
268318441|Rhodothermus_marinus_DSM_4252_uid41729|part_CAS-I-U:0.48885,(
73670571|Methanosarcina_barkeri_Fusaro_uid57715|CAS-I-U:0.38129,(
397781631|Methanoculleus_bourgensis_MS2_uid171377|CAS-I-U:0.17353,
386002385|Methanosaeta_harundinacea_6Ac_uid81199|CAS-III-B:0.24777}0.897:0.11092}0.997:0.18744}0.915:0.07946,((
134101617|Saccharopolyspora_erythraea_NRRL_2338_uid62947|CAS-III-D:0.63340,(
397669411|Propionibacterium_propionicum_F0230a_uid170533|part_CAS-I-U:0.36475,((
433631914|Mycobacterium_canettii_CIPT_140070010_uid184828|CAS-I-U:0.00014,(
433635878|Mycobacterium_canettii_CIPT_140070017_uid184830|CAS-I-U:0.01757,(
433643006|Mycobacterium_canettii_CIPT_140070008_uid184832|CAS-I-U:0.00682}0.927:0.2125}1.000:0.30947,(
397671369|Propionibacterium_propionicum_F0230a_uid170533|part_CAS-I-U:0.43722,
378719041|Gordonia_polyisoprenivorans_VH2_uid86651|CAS-I-U:0.35023}0.434:0.04697}0.818:0.08237}0.886:0.09147
}0.970:0.11822,296121696|Planctomyces_limnophilus_DSM_3776_uid48643|part_unk_CAS-II-C_CAS-V-A_:0.45147}0.843:04036
}0.915:0.04798,{320102061|Isosphaera_pallida_ATCC_43644_uid62207|part_CAS-I-U:0.46497,
347756766|Candidatus_Chloracidobacterium_thermophilum_B_uid73587|CAS-I-U:0.37674}0.886:0.09605}0.752:0.06225,(
262198025|Haliangium_ochraceum_DSM_14365_uid41425|CAS-I-U:0.39510,(
521460287|Sorangium_cellulosum_So0157_2_uid210741|CAS-I-U:0.02271,
162448539|Sorangium_cellulosum__So_ce_56__uid61629|CAS-I-U:0.13373}1.000:0.30801}0.913:0.13663}0.459:0.03224,(
392375776|Candidatus_Methylomirabilis_oxyfera_uid161981|CAS-I-U:0.26535,(
39995168|Geobacter_sulfurreducens_PCA_uid57743|CAS-I-U:0.29443,(
220935599|Thioalkalivibrio_sulfidophilus_HL_EbGr7_uid59179|CAS-I-U:0.17423,
431930657|Thioflavicoccus_mobilis_8321_uid184343|CAS-I-U:0.17126}0.983:0.14210}0.988:0.10868}0.941:0.10191}0.962:0.08521
}0.943:0.09811}0.657:0.08336}0.198:0.06109}0.544:0.11357}0.888:0.08222}0.842:0.05388,((
328953000|Desulfobacca_acetoxidans_DSM_11109_uid65785|part_unk_CAS-II-C_CAS-V-A_:0.59032,(
385790829|Fibrobacter_succinogenes_S85_uid61919|part_CAS-III-D:0.0,
```

FIG. 10H-2

```
261415948|Fibrobacter_succinogenes_S85_uid41169|part_CAS-III-D:0.0):0.82347)0.973:0.24272,(((
269798874|Veillonella_parvula_DSM_2008_uid41927|CAS-III-A_CAS-III-D:1.04377,(
294676823|Rhodobacter_capsulatus_SB_1003_uid47509|part_CAS-III-D:0.60489,(
374998939|Azospirillum_lipoferum_4B_uid82343|CAS-III-B:0.31920,(
389875622|Tistrella_mobilis_KA081020_065_uid167486|CAS-III-D:0.57578,(
302343124|Desulfarculus_baarsii_DSM_2075_uid51371|part_CAS-III-D:0.62485,
288957883|Azospirillum_B510_uid46085|part_CAS-III-D:0.25850)0.775:0.08562)0.959:0.14752)0.934:0.13786)1.000:0.38788
)0.958:0.20515,((((550990421|Comamonadaceae_bacterium_CR_uid223378|CAS-III-A_CAS-III-B:0.41874,
430760780|Thrioalkalivibrio_nitratireducens_DSM_14787_uid184011|CAS-III-B:0.31239)0.997:0.26504,(
292492856|Nitrosococcus_halophilus_Nc4_uid46803|part_CAS-III:0.50117,
121997419|Halorhodospira_halophila_SL1_uid58473|CAS-III-B:0.65781)0.274:0.05550)0.889:0.18609,(
206890539|Thermodesulfovibrio_yellowstonii_DSM_11347_uid59257|CAS-III-A:0.77308,((
257093773|Candidatus_Accumulibacter_phosphatis_clade_IIA_UW_1_uid59207|CAS-III-B:0.28912,(
30248142|Nitrosomonas_europaea_ATCC_19718_uid57647|CAS-III-A:0.08195,
114332190|Nitrosomonas_eutropha_C91_uid58363|CAS-III-A:0.11179)1.000:0.42405)0.747:0.06631,(
332290352|Gallibacterium_anatis_UMN179_uid66567|CAS-III-A:0.48186,
52425690|Mannheimia_succiniciproducens_MBEL55E_uid58197|CAS-III-A:0.64419)0.833:0.08727)0.983:0.20318)0.130:0.11310
)0.977:0.23928,((288947693|Allochrimatium_vinosum_DSM_180_uid46083|part_unk_CAS-III-A_CAS-I-F_:0.52027,
431929780|Thioflavicoccus_mobilis_8321_uid184343|CAS-III-B:0.58283)0.995:0.39665,
541863916|Serratia_ATCC_39006_uid218470|CAS-III-A:1.28772)0.814:0.08548)0.998:0.30856)0.596:0.12247,((((
357419091|Thermovirga_lienii_DSM_1729a_uid77129|part_CAS-III-A:1.37482,(((((((((
432329386|Aciduliprofundum_MAR08_339_uid184407|CAS-I-B:0.33705,(
91773111|Methanococcoides_burtonii_DSM_6242_uid58023|CAS-I-B:0.11522,
20092470|Methanosarcina_acetivorans_C2A_uid57879|CAS-I-B:0.12533)1.000:0.24906)0.993:0.13618,((
315230242|Thermococcus_barophilus_MP_uid54733|CAS-I-A:0.02823,(((
296109603|Methanocaldococcus_infernus_ME_uid48803|CAS-I-B:0.24471,(((
289192644|Methanocaldococcus_FS406_22_uid42499|CAS-I-B_CAS-I-A:0.02353,
261402133|Methanocaldococcus_vulcanius_M7_uid41131|CAS-I-D:0.03573)0.916:0.01734,
15668554|Methanocaldococcus_jannaschii_DSM_2661_uid57713|CAS-I-A:0.01030)0.736:0.00822,
256811373|Methanocaldococcus_fervens_AG86_uid59347|CAS-I-A_CAS-I-B:0.01282)0.988:0.08398)0.974:0.07063,
333910103|Methanotorris_igneus_Kol_5_uid67321|CAS-I-D:0.06717)0.983:0.07080,(((
530547484|Thermococcus_litoralis_DSM_5473_uid82997|CAS-I-A_CAS-I-B:0.07089,(
57640390|Thermococcus_kodakarensis_KOD1_uid58225|CAS-I-A_CAS-I-B:0.06696,((
223476990|Thermococcus_AM4_uid54735|CAS-I-B:0.06156,390960552|Thermococcus_CL1_uid168259|CAS-I-B:0.05216)0.997:0.06951,
341581817|Thermococcus_4557_uid70841|CAS-I-A:0.07037)0.958:0.03862)0.948:0.04794)0.925:0.03717,(
332159453|Pyrococcus_NA2_uid66551|CAS-I-A_CAS-I-B:0.09091,(14591064|Pyrococcus_horikoshii_OT3_uid57753|CAS-I-B:0.07849,(
397651620|Pyrococcus_furiosus_COM1_uid169620|CAS-I-B_CAS-III-B:0.0,
18977490|Pyrococcus_furiosus_DSM_3638_uid57873|CAS-I-B_CAS-III-B:0.0):0.08675)0.806:0.02810)0.994:0.08267)0.920:0.02822,
(337284443|Pyrococcus_yayanosii_CH1_uid68281|CAS-I-B_CAS-I-A:0.10971,
242399467|Thermococcus_sibiricus_MM_739_uid59399|CAS-I-B:0.11016)0.482:0.01794)0.942:0.04621)0.181:0.02143
)1.000:0.35666,(84489745|Methanosphaera_stadtmanae_DSM_3091_uid58407|CAS-I-B:0.40728,(
15679095|Methanothermobacter_thermautotrophicus_Delta_H_uid57877|CAS-III-A_CAS-I-B:0.27796,((
148642224|Methanobrevibacter_smithii_ATCC_35061_uid58827|CAS-I-B:0.09305,(
509154231|Methanobrevibacter_AbM4_uid206515|CAS-I-B:0.07250,
```

FIG. 10I-1

288560055|Methanobrevibacter_ruminantium_M1_uid45857|CAS-I-B:0.08133)0.938:0.06246)1.000:0.15766,(
566002379|Methanobacterium_MB1_uid231690|CAS-I-B:0..09718,333987620|Methanobacterium_SWAN_1_uid67359|CAS-I-B:0.11646
)0.839:0.03371)0.610:0.06670)0.968:0.08958)0.953:0.07196)0.663:0.05261)0.914:0.06057,((
11500011|Archaeoglobus_fulgidus_DSM_4304_uid57717|part_CAS-I-B:0.19374,(
488600764|Archaeoglobus_sulfatocallidus_PM70_1_uid201033|CAS-I-A:0.13022,
327400671|Archaeoglobus_veneficus_SNP6_uid65269|CAS-I-B:0.12321)0.586:0.08038)0.999:0.19057,((
297619085|Methanococcus_voltae_A3_uid49529|CAS-III-B_CAS-I-B:0.22427,
336121113|Methanothermococcus_okinawensis_IH1_uid51535|CAS-I-D:0.21003)0.999:0.18948,
518651364|Ferroplasma_acidarmanus_fer1_uid54095|CAS-I-B:0.55980)0.426:0.06649)0.843:0.07382)0.971:0.09588,((((
84489236|Methanosphaera_stadtmanae_DSM_3091_uid58407|CAS-I-B:0.40801,(
289596694|Aciduliprofundum_boonei_T469_uid43333|CAS-III-A:0.40079,(
48477121|Pictrophilus_torridus_DSM_9790_uid58041|CAS-III-A:0.16742,
13540937|Thermoplasma_volcanium_GSS1_uid57751|CAS-III-A:0.26514)1.000:0.37451)0.939:0.10302)0.444:0.09870,((
14590110|Pyrococcus_horikoshii_OT3_uid57753|CAS-III-A_CAS-I-B:0.13761,(
389851559|Pyrococcus_ST04_uid167261|CAS-I-B_CAS-III-A:0.14974,(390961970|Thermococcus_CL1_uid168259|CAS-I-B:0.04623,(
337284924|Pyrococcus_yayanosii_CH1_uid68281|CAS-III-A_CAS-I-B:0.12743,
341581203|Thermococcus_4557_uid70841|CAS-I-B:0.10152)0.279:0.05649)0.999:0.14015)0.660:0.07042)0.991:0.21805,
390962116|Thermococcus_CL1_uid168259|CAS-III-A:0.79193)0.988:0.23712)0.655:0.07713,
41614813|Nanoarchaeum_equitans_Kin4_M_uid58009|CAS-I-B:0.68297)0.417:0.05985,
48477075|Picrophilous_torridus_DSM_9790_uid58041|CAS-I-D:0.77382)0.747:0.02381)0.996:0.11481,(((
337285608|Thermodesulfatator_indicus_DSM_15286_uid68285|CAS-III-C_CAS-I-B:0.46249,(
452943614|Hydrogenobaculum_HO_uid190882|part_CASE-I-B:0.27751,(
291278961|Deferribacter_desulfuricans_SSM1_uid46653|CAS-I-B:0.21078,(
384129305|Hydrogenobacter_thermophilus_TK_6_uid159875|CAS-I-B:0.0,

FIG. 10I-2

```
288818552 |Hydrogenobacter_thermophilus_TK_6_uid45927 |CAS-I-B:0.0):0.17232)0.640:0.08537)0.950:0.09457)0.883:0.05516,((((
206900175 |Dictyoglomus_thermophilum_H_6_12_uid59439 |CAS-I-B:0.15313,
217967015 |Dictyoglomus_turgidum_DSM_6724_uid59177 |CAS-III-A_CAS-I-B:0.09146)1.000:0.16902,((
125974782 |Clostridium_thermocellum_ATCC_27405_uid57917 |CAS-I-B:0.0,
385780234 | Clostridium_thermocellum_DSM_1313_uid161989 |CAS-I-B:0.0):0.24350,(((
222530612 |Caldicellulosiruptor_bescii_DSM_6725_uid59201 |CAS-I-B:0.00014,(
312623502 |Caldicellulosiruptor_Kronotskyensis_2002_uid60491 |CAS-I-B:0.02342,(
312128727 |Caldicellulosiruptor_hydrothermalis_108_uid60157 |CAS-I-B:0.00015,
146295140 |Caldicellulosiruptor_saccharolyticus_DSM_8903_uid58289 |CAS-I-B_CAS-III-A:0.00658)0.719:0.00661)0.757:0.00332
)0.806:0.00014,(312794650 |Caldicellulosiruptor_Kristjanssonii_177R1B_uid60393 |CAS-I-B_CAS-III-A:0.00014,
344997553 |Caldicellulosiruptor_lactoaceticus_6A_uid60575 |CAS-I-B:0.00329)0.813:0.00324)1.000:0.29280,(
154259624 |Fervidobacterium_nodosum_Rt17_B1_uid58625 |CAS-I-B:0.04244,
217077321 |Thermosipho_africanus_TCF52B_uid59095 |CAS-I-B:0.02729)0.999:0.18105)0.998:0.15802)0.684:0.06849)0.392:0.04359,
(((((114568021 |Syntrophomonas_wolfei_Goettingen_uid58179 |CAS-I-B_CAS-III-D:0.28160,
410668744 |Thermacetogenium_phaeum_DSM_12270_uid177811 |CAS-I-B_CAS-III_D:0.25776)0.942:0.07311,(((
219669947 |Desulfitobacterium_hafniense_DCB_2_uid57749 |CAS-I-B:0.0,
89895510 |Desulfitobacterium_hafniense_Y51_uid58605 |CAS-I-B:0.0):0.23485,(
295697278 |Kyrpidia_tusciae_DSM_2912_uid48361 |CAS-I-B_CAS-I-B:0.30828,
430751276 |Thermobacillus_composti_KWC4_uid74021 |CAS-I-B:0.30842)0.741:0.06985)0.070:0.04001,((((
134298414 |Desulfotomaculum_reducens_MI_1_uid58277 |CAS-I-B:0.22638,(
334341514 |Desulfotomaculum_ruminis_DSM_2154_uid67507 |CAS-I-B:0.13916,(
488774623 |Desulfotomaculum_gibsoniae_DSM_7213_uid76945 |CAS-I-B:0.07833,
147678249 |Pelotomaculum_thermopropionicum_SI_uid58899 |CAS-I-B_CAS-III-B:0.03623)0.999:0.09895)0.839:0.04072
)0.983:0.07467,(258517354 |Desulfotomaculum_acetoxidans_DSM_771_uid59109 |CAS-I-B:0.22433,(
296133980 |Thermincola_potens_JR_uid48823 |CAS-I-B:0.21819,
78043644 |Carboxydothermus_hydrogenoformans_Z_2901_uid57821 |CAS-III-A_CAS-I-B:0.32989)0.903:0.05739)0.522:0.00936
)0.971:0.05504,((((312794692 Caldicellulosiruptor_kristjanssonii_177R1B_uid60393 CAS-I-B:0.0,
344997601 Caldicellulosiruptor_lactoaceticus_6A_uid60575 |CAS-I-B_CAS-III-D:0.0):0.02342,
302872861 |Caldicellulosiruptor_obsidiansis_OB47_uid51501 |CAS-II-A_CAS-I-B:0.03520)1.000:0.23231,
302388669 |Thermosediminibacter_oceani_DSM_16646_uid51421 |part_CAS-I-B:0.22278)0.890:0.04219,((
333898074 |Thermoanaerobacterium_xylanolyticum_LX_11_uid63163 |CAS-I-B_CAS-III-D:0.02816,(
304318003 |Thermoanaerobacterium_thermosaccharolyticum_DSM_571_uid51639 |CAS-I-B_CAS-III-D:0.000336,
433656210 |Thermoanaerobacterium_thermosaccharolyticum_M0795_uid184821 |CAS-I-B_CAS-III-D:0.00016)0.931:0.02396
)1.000:0.12431,((289579423 |Thermoanaerobacter_itakicus_Ab9_uid46241 |CAS-I-B:0.0,
297545564 |Thermoanaerobacter_mathranii_A3_uid49481 |CAS-I-B:0.0):0.02421,((
320114993 |Thermoanaerobacter_brockii_finnii_Ako_1_uid55639 |CAS-I-B:0.0,
167036565 |Thermoanaerobacter_pseudethanolicus_ATCC_33223_uid58339 |part_CAS-I-B:0.0):0.00016,((
307725454 |Thermoanaerobacter_X513_uid53065 |CAS-I-B:0.0,167040929 |Thermoanaerobacter_X514_uid58589 |CAS-I-B:0.0):0.00015,
345018873 |Thermoanaerobacter_wiegelii_Rt8_B1_uid52581 |CAS-I-B:0.00673)0.903:0.00336)0.906:0.01324)0.999:0.07557
)0.991:0.07889)0.972:0.05966)0.927:0.05452,(332982754 |Mahella_australiensis_50_1_BON_uid66917 |CAS-I-B:0.24714,(
379008964 |Sulfobacillus_acidophilus_DSM_10332_uid88061 |CAS-I-B:0.00014,
339628806 |Sulfobacillus_acidophilus_TPY)uid68841 |CAS-I-B:0.00366)1.000:0.46500)0.688:0.05790)0.407:0.02345)0.850:0.04561
)0.856:0.04470,((312112401 |Geobacillus_Y4_1MC1_uid55779 |CAS-I-B:0.00015,
336236852 |Geobacillus_thermoglucosidasius_C56_YS93_uid48129 |CAS-I-B:0.00663)1.000:0.23694,(
239825879 |Geobacillus_WCH70_uid59045 |CAS-I-B_CAS-III-B:0.06247,(
```

FIG. 10J-1

```
319765457 |Geobacillus_Y412MC52_uid55381 |CAS-I-B_CAS-II-B:0.0,
261418641 |Geobacillus_Y412MC61_uid1171 |CAS-I-B_CAS-II-B:0.0):0.10357)0.970:0.10119)1.000:0.22109)0.808:0.03443,((((
357419113 |Thermovirga_lienii_DSM_17291_uid77129 |CAS-I-B:0.16607,(
479198700 |Synergistetes_bacterium_SGP1_uid197182 |part_CAS-I-B:0.30895,
292407912 |Anaerobaculum_mobile_DSM_13181_uid168323 |CAS-I-B:0.24277)0.942:0.06487)0.999:0.18235,(
239617067 |Kosmotoga_olearia_TBF_19_5_1_uid59205 |CAS-III-C_CAS-I-B:0.08626,
389845095 |Mesotoga_prima_MesG1_Ag_4_2_uid52599 |CAS-III-C_CAS-I-B:0.10054)1.000:0.27313)0.518:0.05081,((
108803109 |Rubrobacter_xylanophilus_DSM_9941_uid58057 |CAS-III-B_CAS-I-B:0.16986,
269839455 |Thermobaculem_terrenum_ATCC_BAA_798_uid2011 |CAS-I-B:0.23784)1.000:0.24867,(
328951570 |Marinithermus_hydrothermalis_DSM_14884_uid65783 |part_CAS-I-B:0.28478,(
221632058 |Thermomicrobium_roseum_DSM_5159_uid59341 |CAS-I-B:0.23133,
384438634 |Thermus_CCB_US3_UF1_uid81197|CAS-III-B_CAS-I-B:0.33757)0.893:0.09050)0.998:0.18026)0.920:0.10179
)0.419:0.06119,(((157363075 |Thermotoga_lettingae_TMO_uid58419 |CAS-I-B:0.27425,
338731442 |Thermotoga_thermarum_DSM_5069_uid68449 |CAS-I-B:0.15923)0.986:0.14099,(
160903306 |Petrotoga_mobilis_SJ95_uid58747 |CAS-I-B:0.38193,(
170288818 |Thermotoga_RQ2_uid58935 |CAS-III-A_CAS-I-B_CAS-III-B:0.03148,(
568318827 |Thermotoga_maritima_MSB8_uid179902 |CAS-III-A_CAS-I-B_CAS-III-B:0.0,
499080547 |Thermotoga_maritima_MSB8_uid202924 |CAS-III-B_CAS-I-B_CAS-III-A:0.0,
15644541 |Thermotoga_maritima_MSB8_uid57723 |CAS-III-B_CAS-I-B_CAS-III-A:0.0):0.01195)1.000:0.38651)0.836:0.11305
)0.732:0.06031)0.832:0.04434)0.405:0.02146,((
338730939 |Thermotoga_thermarum_DSM_5069_uid68449 |CAS-I-B_CAS-III-B_CAS-III-A:0.20427,(
20809992 |Thermoanaerobacter_tengcongensis_MB4_uid57813 |CAS-I-B:0.14817,(
260892568 |Ammonifex_degensii_KC4_uid41053 |part_CAS-I-B:0.21759,(
```

FIG. 10J-2

```
169831957|Candidatus_Desulforudis_audaxviator_MP104C_uid59067|CAS-III_CAS-I-B_CAS-III-B:0.18175,
333977937|Desulfotomaculum_kuznetsovii_DSM_6115_uid67357|CAS-III-B_CAS-I-B:0.10597)0.884:0.04075)0.962:0.07307
)0.448:0.05258)1.000:0.21795,206889641|Thermodesulfovibrio_yellowstonii_DSM_11347_uid59257|CAS-III-C:0.26686
)0.864:0.05178)0.390:0.02728)0.987:0.07836,((
332295661|Thermodesulfobium_narugense_DSM)14796_uid66601|CAS-I-B_-III-D:0.35275,(
374339292|Marinitoga_piezophila_KA3_uid81629|CAS-I-B:0.23131,(
217078000|Thermosipho_africanus_TCF52B_uid59095|CAS-I-B:0.13055,
150020249|Thermosipho_melanesiensis_B1429_uid58683|CAS-I-B:0.15173)0.998:0.13729)0.429:0.05219)0.991:0.10699,((
319956800|Nitratifractor_salsuginis_DSM_16511_uid62183|CAS-I-B:0.12327,(
157164052|Campylobacter_concisus_13826_uid58667|CAS-I-B:0.10834,
154174048|Campylobacter_curvus_525_92_uid58669|CAS-I-B:0.04823)0.935:0.12798)1.000:0.94956,
518652584|Ferroplasma_acidarmanus_fer1_uid54095|CAS-I-B:0.33003)0.201:0.15365)0.713:0.03057)0.914:0.04666)0.945:0.05998,
(385809790|Ignavibacterium_album_JCM_16511_uid162097|part_CAS-I-B:0.69314,((
154250065|Fervidobacterium_nodosum_Rt17_B1_uid58625|CAS-III-A:0.14320,
383787172|Fervidobacterium_pennivorans_DSM_9078_uid78143|CAS-III-B_CAS-III-A:0.13664)0.999:0.19590,(
217076447|Thermosipho_africanus_TCF52B_uid59095|CAS-III-B:0.18912,
150021526|Thermosipho_melanesiensis_B1429_uid58683|CAS-III-B_CAS-III-A:0.20581)0.970:0.13239)1.000:0.30937)0.682:0.11054
)0.927:0.06540)0.802:0.03171,(((((554379177|Clostridium_autoethanogenum_DSM_10061_uid225029|CAS-I-B:0.08082,(
153955370|Clostridium_kluyveri_DSM_555_uid58885|CAS-I-B:0.0,
219855788|Clostridium_kluyveri_NBRC_12016_uid59369|CAS-I-B:0.0):0.09720)1.000:0.15760,(((
557235791|Campylobacter_03_427_uid226993|CAS-I-B:0.04099,118475338|Campylobacter_fetus_82_40_uid58545|CAS-I-B:0.02420
)1.000:0.26089,((390940098|Sulfurospirillum_barnesii_SES_3_uid168117|CAS-I-B:0.01040,
268679536|Sulfurospirillum_deleyianum_DSM_6946_uid41861|CAS-I-B:0.00015)0.989:0.07878,(
384172708|Arcobacter_L_uid158135|CAS-I-B:0.10626,296274322|Arcobacter_nitrofigilis_DSM_7299_uid49001|CAS-I-B:0.10293
)0.906:0.06293)0.999:0.15758)0.866:0.08363,(336115128|Bacillus_coagulans_2_6_uid68053|CAS-I-B:0.24240,(
114567318|Syntrophomonas_wolfei_Goettingen_uid58179|CAS-I-B:0.10299,(
258516154|Desulfotomaculum_acetoxidans_DSM_771_uid59109|CAS-I-B:0.06571,
488774373|Desulfotomaculum_gibsoniae_DSM_7213_uid76945|CAS-I-B:0.01494)0.879:0.04453)1.000:0.23915)0.000:0.06135
)0.912:0.06522)0.771:0.07121,(118443013|Clostridium_novyi_NT_uid58643|CAS-I-B:0.15283,(((
557605540|Clostridium_tetani_12124569_uid227214|CAS-I-B:0.00016,28211139|Clostridium_tetani_E88_uid57683|CAS-I-B:0.00328
)1.000:0.13505,)550918912|Clostridium_saccharobutylicum_DSM_13864_uid223284|CAS-I-B:0.10291,
507380410|Fusobacterium_4_8_uid205051|CAS-I-B:0.19382)0.876:0.06724)0.928:0.06331,
310825770|Eubacterium_limosum_KIST612_uid59777|CAS-I-B:0.19491)0.180:0.01649)0.944:0.06444)1.000:0.52984,(
297617514|Syntrophothermus_lipocalidus_DSM_12680_uid49527|CAS-I-B_CAS-III-B:0.49395,((
15605875|Aquifex_aeolicus_VF5_uid57765|CAS-I-B_CAS-III-B:0.20698,(452944366|Hydrogenobaculum_HO_uid190882|CAS-I-B:0.0,
471264734|Hydrogenobaculum_SN_uid46251|part_CAS-I-B:0.0):0.37022)1.000:0.22371,(
337288767|Thermodesulfobacterium_OPB45_uid68283|part_CAS-I-B:0.38122,((
222099688|Thermotoga_neapolitana_DSM_4359_uid59065|CAS-I-B:0.06402,
148270212|Thermotoga_petrophila_RKU_1_uid58655|CAS-I-B_CAS-III-A:0.06676)1.000:0.21863,(
333978075|Desulfotomaculum_kuznetsovii_DSM_6115_uid67357|CAS-I-B:0.22753,
83590562|Moorella_thermoacetica_ATCC_39073_uid58051|CAS-I-B:0.17806)0.996:0.13595)0.712:0.06895)0.906:0.06509
)0.925:0.07614)0.862:0.04341)0.825:0.02689,(((
304318086|Thermoanaerobacterium_thermosaccharolyticum_DSM_571_uid51639|CAS-I-A:0.03179,
333898147|Thermoanaerobacterium_xylanolyticum_LX_11_uid63163|CAS-I-B:0.01167)1.000:0.34499,((
188996612|Sulfurihydrogenibium_YO3AOP1_uid58855|CAS-III-B_CAS-I-B:0.20107,(
```

FIG. 10K-1

```
225850878|Persephonella_marina_EX_H1_uid58119|CAS-I-B:0.10996,
225848645|Sulfurihydrogenibium_azorense_Az_Fu1_uid58121|CAS-I-B:0.09490)1.000:0.22731)0.959:0.09996,((
206900356|Dictyoglomus_thermophilum_H_6_12_uid59439|CAS-I-B:0.20492,(
383787935|Caldisericum_exile_AZM16c01_uid158173|CAS-I-B:0.26802,(
313673874|Calditerrivibrio_nitroreducens_DSM_19672_uid60821|CAS-I-B:0.13438,
206889560|Thermodesulfovibrio_yellowstonii_DSM_11347_uid59257|CAS-I-B:0.10798)0.983:0.10036)0.857:0.06228)0.972:0.09180,
(((222528176|Caldicellulosiruptor_bescii_DSM_6725_uid59201|CAS-I-B_CAS-III-D:0.04268,(
146295386|Caldicellulosiruptor_saccharolyticus_DSM_8903_uid58289|CAS-I-B:0.0,
146297392|Caldicellulosiruptor_saccharolyticus_DSM_8903_uid58289|CAS-I-B:0.0):0.01342)0.983:0.04609,((
302870841|Caldicellulosiruptor_obsidiansis_OB47_uid51501|CAS-I-B_CAS-III-B:0.00653,
312134146|Caldicellulosiruptor_owensensis_OL_uid60165|CAS-I-B:0.02469)0.993:0.04470,(((
312128678|Caldicellulosiruptor_hydrothermalis_108_uid60157|CAS-I-B:0.02067,
312623456|Caldicellulosiruptor_kronotskyensis_2002_uid60491|CAS-III-B_CAS-I-B:0.02167)0.932:0.01338,
297543518|Thermoanaerobacter_mathranii_A3_uid49481|CAS-I-B:0.02463)0.569:0.00688,
312794543|Caldicellulosiruptor_kristjanssonii_177R1B_uid60393|CAS-I-B:0.01414)0.904:0.02004)0.719:0.01995)1.000:0.22782,
((212638614|Anoxybacillus_flavithermus_WK1_uid59135|CAS-I-B:0.06838,(
297529736|Geobacillus_C56_T3_uid49467|CAS-I-B:0.09358,(312110562|Geobacillus_Y4_1MC1_uid55779|CAS-I-B:0.00014,
336235012|Geobacillus_thermoglucosidasius_C56_YS93_uid48129|CAS-I-B:0.00340)0.994:0.05594)0.895:0.02946)1.000:0.24480,(
451821616|Clostridium_saccharoperbutylacetonicum_ATCC_27021_uid189747|CAS-I-B:0.29067,(
126700597|Clostridium_difficile_630_uid57679|CAS-I-B:0.00597,(384362144|Clostridium_difficile_BI1_uid158363|CAS-I-B:0.0,
260684497|Clostridium_difficile_CD196_uid41017|CAS-I-B:0.0,260688155|Clostridium_difficile_R20291_uid40921|CAS-I-B:0.0
):0.00393)1.000:0.23655)0.273:0.04209)0.991:0.10582)0.799:0.08324)0.799:0.04567)0.973:0.10223)0.709:0.04665,((
336323211|Flexistipes_sinusarabici_DSM_4947_uid68147|CAS-I-B:0.43069,(
```

FIG. 10K-2

```
189345988 |Chlorobuim_limicola_DSM_245_uid58127 |CAS-I-B:0.20292,
193216046 |Chloroherpeton_thalassium_ATCC_35110_uid59187 |part_CAS-I:0.21534}0.999:0.23236}0.295:0.10446,(
397689809 |Melioribacter_roseus_P3M_uid170941 |CAS-I-B:0.30730,(
408418420 |Desulfobacula_toluolica_Tol2_uid175777 |CAS-I-B:0.43738,((
511059752 |Methanomassiliicoccus_Mx1_Issoire_uid207287 |CAS-I-B:0.40141,(((
379012740 |Acetobacterium_woodii_DSM_1030_uid88073 |CAS-I-B:0.17785,(
557605419 |Clostridium_tetani_12124569_uid227214 |CAS-I-B:0.01099,28210841 |Clostridium_tetani_E88_uid57683 |CAS-I-B:0.02363
)1.000:0.13742_0.956:0.06454,(19704512 |Fusobacterium_nucleatum_ATCC_25586_uid57885 |CAS-I-B:0.17142,
479154410 |Ruminococcus_uid197156 |CAS-I-B:0.21614}0.576:0.05763}0.984:0.10048,(
296126271 |Brachyspira_murdochii_DSM_12563_uid48819|CAS-I-B:0.28317,(
442805096|Clostridium_stercorarium_DSM_8532_uid186819|CAS-I-B:0.0,
472466986|Clostridium_stercorarium_DSM_8532_uid195569|CAS-I-B:0.0}:0.26459}0.891:0.07308}0.191:0.05239}0.196:0.03515,((
150389964 |Alkaliphilus_metalliredigens_QYMF_uid58171|CAS-I-B:0.15724,
407473145|Clostridium_acidurici_9a_uid176126|CAS-I-B:0.11391}1.000:0.21229,(((
347547913 |Listeria_ivanovii_PAM_55_uid73473|CAS-I-B:0.02498,((
386052779 |Listeria_monocytogenes_Finland_1998_uid54443|CAS-I-B:0.00014,
525868764|Vibrio_parahaemolyticus_01_K33_CDC_K4557_uid212977|CAS-I-B:0.00337}1.000:0.07255,
289433792 |Listeria_seeligeri_serovar_1_2b_SLCC3954_uid46215|CAS-I-B:0.00894}0.558:0.01882}1.000:0.18056,(
258514214 |Desulfotomaculum_acetoxidans_DSM_771_uid59109|CAS-I-B:0.08878,
325289514 |Syntrophobotulus_glycolicus_DSM_8271_uid63343|CAS-I-B:0.07743}1.000:0.13742}0.903:0.05050,(
257125579|Leptotrichia_buccalis_C_1013_b_uid59211|CAS-I-B:0.18740,
347525482|Lactobacillus_ruminis_ATCC_27782_uid73417|CAS-I-B:0.37792}0.110:0.05221}0.994:0.10871}0.208:0.05650
}0.569:0.06607}0.905:0.07613}0.547:0.05498}0.036:0.04874}0.802:0.02368}0.931:0.04542}0.910:0.07982,((
268317185|Rhodothermus_marinus_DSM_4252_uid41729|CAS-III-A_CAS-I-B:0.00016,
345303027|Rhodothermus_marinus_SG0_5JP17_172_uid72767|CAS-I-B_CAS-III-D_CAS-III-A:0.00685}1.000:0.52753,((
375256010|Tannerella_forsythia_ATCC_43037_uid83157|CAS-I-B_CAS-III-A:0.10241,((
188995823|Porphyromonas_gingivalis_ATCC_33277_uid58879|CAS-I-B:0.00781,(
334146098|Prophyromonas_gingivalis_TDC60_uid67407|CAS-I-B:0.0,34541603|Porphyromonas_gingivalis_W83_uid57641|CAS-I-B:0.0
):0.00572}1.000:0.19144,53713835|Bacteroides_fragilis_YCH46_uid58195|CAS-I-B:0.16187}0.967:0.07910}0.968:0.11609,(
332662474|Haliscomenobacter_hydrossis_DSM_1100_uid66777|CAS-I-B:0.33769,(
325279973|Odoribacter_splanchnicus_DSM_20712_uid63397|CAS-I0B:0.20268,
338214362|Runella_slithyformis_DSM_19594_uid68317|CAS-I-B:0.19385}0.834:0.07284}0.262:0.08619}0.999:0.24987
}0.450:0.08301}0.766:0.05564,389844445|Mesotoga_prima_MesG1_Ag_4_2_uid52599|CAS-III-B_CAS-I-B:0.64759}0.849:0.08217,((
292653771|Haloferax_volcanii_DS2_uid46845|CAS-I-B:0.18707,
222481209|Halorubrum_lacusprofundi_ATCC_49239_uid58807|CAS-I-B:0.16495}1.000:0.24031,((
429193351}Natronobacterium_gregoryi_SP2_uid74439|CAS-I-B:0.12821,((
344209644|Haloarcula_hispanica_ATCC_33960_uid72472|CAS-I-B:0.0,564287902|Haloarcula_hispanica_N601_uid230920|CAS-I-B:0.0
):0.03985,385803535|Haloquadratum_walsbyi_C23_uid162019|CAS-I-B:0.08557}0.454:0.04423}0.998:0.15939,((
529078026|Halorhabdus_tiamatea_SARL4B_uid214082|CAS-I-B:0.02075,
257052525|Halorhabdus_utahensis_DSM_12940_uid59189|CAS-I-B:0.01348}1.000:0.20480,(
55376278|Haloarcula_marismortui_ATCC_43049_uid57719|CAS-I-B:0.14793,(
389849193|Haloferax_mediterranei_ATCC_33500_uid167315|CAS-I-B:0.16754,(
257388877|Halomicrobium_mukohataei_DSM_12286_uid59107|CAS-I-B:0.03317,397772707|Natrinema_J7_uid171337|CAS-I-B:0.06068
)0.999:0.12945}0.657:0.03116}0.730:0.04642}0.666:0.06365}0.985:0.15239}1.000:0.31781}0.940:0.10827,(
111224947|Frankia_alni_ACN14a_uid58695|CAS-I-B:0.08716,(
```

FIG. 10L-1

```
145593555|Salinispora_tropica_CNB_440_uid58565|CAS-I-B_CAS-III-D:0.13325,
269125191|Thermomonospora_curvata_DSM_43183_uid41885|CAS-I-B_CAS-I-E:0.17190)0.927:0.09099}1.000:0.83962)0.099:0.06351,
292491938|Nitrosococcus_halophilus_Nc4_uid46803|CAS-I-D:0.83623)0.897:0.15205)0.997:0.35891,((
337288662|Thermodesulfobacterium_OPB45_uid68283|CAS-III-A:0.91811,
319790504|Thermovibrio_ammonificans_HB_1_uid62095|part_unk_CAS-II-C_CAS-III-A_:0.81828)0.998:0.62970,((
436839745|Desulfovibrio_hydrothermalis_AM13___DSM_14728_uid184831|CAS-III-B:0.0,
551593629|Desulfovibrio_hydrothermalis_AM13___DSM_14728_uid184831|CAS-III-B:0.0):0.94627,((
407014431|uncultured|CAS-V-A:0.65862,((822613930|Arcobacter|CAS-V-A:0.41614,(((99999|Gut_metagenome|CAS-V-A:0.31072,
655445888|Proteocatella|CAS-V-A:0.45859)0.973:0.14953,491540983|Helcococcus|CAS-V-A:0.46509)0.782:0.12210,(((
498141436|Succinivibrionaceae|CAS-V-A:0.30624,544361016|Acidaminococcus|CAS-V-A:0.34057)0.369:0.06956,((
740127301|Synergistes|CAS-V-A:0.24912,653158546|Anaerovibrio|CAS-V-A:0.36932)0.514:0.10242,(
478482904|archaeon_Mx1201_uid196597|CAS-V-A:0.33417,731481691|Candidatus|CAS-V-A:0.21082)0.981:0.16341)0.032:0.08109
)0.750:0.08578,(524816321|Eubacterium|CAS-V-A:0.35664,809198073|Sneathia|CAS-V-A:0.65459)0.350:0.04599)0.947:0.09077
)0.959:0.09608)0.798:0.08021,(529312665|Leptospira|CAS-V-A:0.36703,(676549650|Smithella_sp_SCADC|CAS-V-A:0.25358,
800943164|Flavobacterium|CAS-V-A:0.38617)0.668:0.08857)0.949:0.10339)0.997:0.30899)0.717:0.09544,((((
818703644|Parcubacteria_bacterium_GW2011_GWC2_44_17|CAS-V-A:0.00014,
818705783|Parcubacteria_bacterium_GW2011_GWF2_44_17|CAS-V-A:0.00015)1.000:0.24268,((
818252814|Peregrinibacteria_bacterium_GW2011_GWC2_33_13|CAS-V-A:0.0,
818249860|Peregrinibacteria_bacterium_GW2011_GWA2_33_10|CAS-V-A:0.0)0.29569,(
406878618|groundwater_metagenome|CAS-V-A:0.29026,818357064|Microgenomates_bacterium_GW2011_GWA2_37_7|CAS-V-A:0.63031
)0.964:0.14398)0.304:0.07630)0.977:0.16312,406932891|groundwater_metagenome|CAS-V-A:0.38965)0.998:0.30074,((
640557445|Prevotella|CAS-V-A:0.29071,(565859199|Porphyromonas|CAS-V-A:0.28034,496509561|Bacteroidetes|CAS-V-A:0.26104
)0.261:0.08167)0.998:0.31633,(639140166|Moraxella|CAS-V-A:0.48330,(
```

FIG. 10L-2

```
167627880 | Francisella_philomiragia_ATCC_25017_uid59105 | CAS-V-A:0.00016,(
118497969 | Francisella_novicida_U112_uid58499 | CAS-V-A:0.00014,
385793361 | Francisella_cf__novicida_Fx1_uid162105 | CAS-V-A:0.00733)0.821:0.00365)0.999:0.38856)0.912:0.15536)0.980:0.19360
)0.727:0.07301)1.000:0.77957)0.958:0.27205)0.749:0.15131)0.691:0.03817,(((
479129287 | Arthrospira_platensis_NIES_39_uid197171 | part_unk_CAS-II-C_CAS-V-A_:2.60580,(
187736488 | Akkermansia_muciniphila_ATCC_BAA_835_uid58985 | CAS-II-C:1.21602,((
117929157 | Acidothermus_cellulolyticus_11B_uid58501 | CAS-II-C:0.42109,(((
375289764 | Corynebacterium_diphtheriae_241_uid83607 | CAS-II-C:0.0,
376283540 | Corynebacterium_diphtheriae_31A_uid84309 | CAS-II-C:0.0,
376286567 | Corynebacterium_diphtheriae_BH8_uid84311 | CAS-II-C:0.0,
376289244 | Corynebacterium_diphtheriae_C7__beta__uid84313 | CAS-II-C:0.0,
376244597 | Corynebacterium_diphtheriae_HC01_uid84297 | CAS-II-C:0.0,
376292155 | Corynebacterium_diphtheriae_HC02_uid84317 | CAS-II-C:0.0,
376256052 | Corynebacterium_diphtheriae_VA01_uid84305 | CAS-II-C:0.0):0.00017,
38232679 | Corynebacterium_diphtheriae_NCTC_13129_uid57691 | CAS-II-C:0.01278)1.000:0.36342,(
283456134 | Bifidobacterium_dentium_Bd1_uid43091 | CAS-II-C:0.17320,
384200945 | Bifidobacterium_longum_KACC_91563_uid158861 | CAS-II-C:0.15856)1.000:0.45118)0.982:0.23822)0.999:0.46953,(((((((
(291276264 | Helicobacter_mustelae_12198_uid46647 | CAS-II-C:0.54318,((
471315928 | Helicobacter_cinaedi_ATCC_BAA_847_uid193765 | CAS-II-C:0.00016,
386762034 | Helicobacter_cinaedi_PAGU611_uid162219 | CAS-II-C:0.00401)0.995:0.17895,(((
544063171 | Campylobacter_jejuni_00_2425_uid219359 | CAS-II-C:0.0,
543948718 | Campylobacter_jejuni_00_2426_uid219324 | CAS-II-C:0.0,
543946931 | Campyloabacter_jejuni_00_2538_uid219325 | CAS-II-C:0.0,
543950498 | Campyloabacter_jejuni_00_2544_uid219326 | CAS-II-C:0.0,
384448745 | Campylobacter_jejuni_IA3902_uid159531 | CAS-II-C:0.0,
403056242 | Campyloabacter_jejuni_NCTC_11168_BN148_uid174152 | CAS-II-C:0.0,
218563120 | Campylobacter_jejuni_NCTC_11168__ATCC_700819_uid57587 | CAS-II-C:0.0,):0.00401,(((
549693478 | Campylobacter_jejuni_4031_uid222817 | CAS-II-C:0.0,157415743 | Campyloabacter_jejuni_81116_uid58771 | CAS-II-C:0.0,
384442101 | Campylobacter_jejuni_M1_uid159535 | CAS-II-C:0.0,):0.00404,
407942867 | Campylobacter_jejuni_PT14_uid176499 | CAS-II-C:0.00011)0.961:0.01214,((
384443889 | Campyloabacter_jejuni_S3_uid159533 | part_ CAS-II-C:0.00396,
525912228 | Vibrio_parahaemolyticus_01_K33_CDC_K4557_uid212977 | CAS-II-C:0.00403)0.000:0.00014,
57238545 | Campyloabacter_jejuni_RM1221_uid57899 | part_ | CAS-II-C:0.00014)0.000:0.0016)0.924:0.00803)0.717:0.00014,
153952137 | Campyloabacter_jejuni_doylei_269_97_uid58671 | CAS-II-C:0.00798)1.000:0.28657)1.000:0.38719)0.804:0.15328,(((((
254804355 | Neisseria_meningitidis_alpha14_uid61649 | CAS-II-C:0.00423,(
313669045 | Neisseria_lactamica_020_06_uid60851 | CAS-II-C:0.00845,
385324781 | Neisseria_meningitidis_8014_uid161967 | CAS-II-C:0.00014)0.772:0.00420)0.798:0.00762,(
385855844 | Neisseria_meningitidis_M01_240355_uid162075 | part_CAS-II-C:0.00847,(
385337434 | Neisseria_meningitidis_WUE_2594_uid162093 | CAS-II-C:0.0,
218767587 | Neisseria_meningitidis_Z2491_uid57819 | CAS-II-C:0.0):0.00015)0.876:0.01377)1.000:0.27999,(
470166766 | Bibersteinia_trehalosi_192_uid193709 | CAS-II-C:0.16428,((
345430423 | Haemophilus_parainfluenzae_T3T1_uid72801 | CAS-II-C:0.19598,(
152978061 | Actinobacillus_succinogenes_130Z_uid58247 | CAS-II-C:0.04063,
407692092 | Actinobacillus_suis_H91_0380_uid176363 | CAS-II-C:0.03772)1.000:0.13174)0.977:0.09908,
15602991 | Pasteurella_multiocida_Pm70_uid57627 | CAS-II-C:0.15451)0.050:0.03898)0.901:0.11258)1.000:0.37423,((
220930481 | Clostridium_cellulolyticum_H10_uid58709 | CAS-II-C:0.46784,
```

FIG. 10M-1

```
222109284 | Acidovorax_ebreus_TPSY_uid59233 | CAS-II-C:0.83032)0.067:0.06591,(
310780383 | Ilyobacter_polytropus_DSM_2926_uid59769 | CAS-II-C:0.49691, 530600687 | Geobacillus_JF8_uid215234 | CAS-II-C:0.50808
)0.635:0.08400)0.790:0.08853)0.537:0.05649,(
189485226 | uncultured_Termite_group_1_bacterium_phylotype_Rs_D17_uid59059 | CAS-I-C_CAS-II-C:0.67203,(
34557789 | Wolinella_succinogenes_DSM_1740_uid61591 | CAS-II-C:0.49905,(((
90425960 | Rhodopseudomonas_palustris_BisB18_uid58443 | CAS-II-C:0.09952,
91975510 | Rhodopseudomonas_palustris_BisB5_uid58440 | CAS-II-C:0.03720)1.000:049634,(
470213513 | Sphingomonas_MM_1_uid193771 | CAS-II-C:0.20678,(
209542526 | Gluconacetobacter_diazotrophicus_PAl_5_uid59075 | CAS-II-C:0.00014,
162147908 | Gluconacetobacter_diazotrophicus_PAl_5_uid61587 | CAS-II-C:0.00433)0.997:0.21540)0.953:0.19716)0.996:0.33299
)0.166:0.13725)0.951:0.14841)0.946:0.14112)0.879:0.10330,(((((
385826040 | Lactobacillus_johnsonii_DPC_6029_uid162057 | CAS-II-A:0.20335,(((
526232449 | Lactobacillus_reuteri_TD1_uid213089 | part_CAS-II-A:0.28508,(
347534531 | Lactobacillus_sanfranciscensis_TMW_1_1304_uid72937 | CAS-II-A:0.35127,(
448819854 | Lactobacillus_plantarum_ZJ316_uid188689 | CAS-II-A:0.27464,(((
385824064 | Lactobacillus_casei_BD_II_uid162119 | CAS-II-A:0.0, 191639136 | Lactobacillus_casei_BL23_uid59237 | CAS-A:0.0,
385820879 | Lactobacillus_casei_LC2W_uid162121 | CAS-II-A:0.0, 40997998 | Lactobacillus_casei_W56_uid178736 | CAS-II-A:0.0,
301067198 | Lactobacillus_casei_Zhang_uid50673 | CAS-II-A:0.0):0.00182,(
523514788 | Lactobacillus_casei_LOCK919_uid210959 | CAS-II-A:0.0,
532357524 | Lactobacillus_paracasei_8700_2_uid55295 | CAS-II-A:0.0):0.01085)0.988:0.14418, ((
385828838 | Lactobacillus_rhamnosus_GG_uid161983 | CAS-II-A:0.0, 258509198 | Lactobacillus_rhamnosus_GG_uid59313 | CAS-II-A:0.0
):0.00014, 523517689 | Lactobacillus_rhamnosus_LOCK900_uid210957 | CAS-II-A:0.0862)0.983:0.12402)1.000:0.41605)0.929:0.09994
```

FIG. 10M-2

)0.276:0.04127)0.129:0.01870,(557607383|Pediococcus_pentosaceus_SL4_uid227215|CAS-II-A:0.24814,(
331702227|Lactobacillus_buchneri_NRRL_B_30929_uid66205|CAS-II-A:0.00653,
406027702|Lactobacillus_buchneri_uid73657|CAS-II-A:0.00632)1.000:0.17758)0.909:0.05043)0.926:0.07849,(
385839901|Lactobacillus_salivarius_CECT_5713_uid162005|CAS-II-A:0.01673,
90961086|Lactobacillus_salivarius_UCC118_uid58233|CAS-II-A:0.00859)1.000:0.26424)0.963:0.10749)0.998:0.29393,(
310286727|Bifidobacterium_bifidum_s17_uid59545|CAS-II-A:0.64225,
406600270|Leuconostoc_gelidum_JB7_uid75682|CAS-II-A:0.43560)0.743:0.09368)0.985:0.21106,((
328956316|Coriobacterium_glomerans_PW2_uid65787|CAS-II-A:0.12076,(
339445982|Eggerthella_YY7918_uid68707|CAS-II-A:0.30084,302336019|Olsenella_uli_DSM_7084_uid51367|CAS-II-A:0.14832
)0.842:0.06225)1.000:0.53679,(((392988475|Enterococcus_hirae_ATCC_9790_uid70619|CAS-II-A:0.12544,
558685082|Enterococcus_mundtii_QU_25_uid229420|CAS-II-A:0.16625)0.786:0.03778,((((((
386338090|Streptococcus_gallolyticus_ATCC_43143_uid162103|CAS-II-A:0.0,
325978668|Streptococcus_gallolyticus_ATCC_BAA_2069_uid63617|CAS-II-A:0.0):0.00014
288905638|Streptococcus_gallolyticus_UCN34_uid46061|CAS-II-A:0.00416)0.845:0.01212,(
379705579|Streptococcus_infantarius)CJ18_uid87033|CAS-II-A:0.01675,
527330433|Streptococcus_lutetiensis_033_uid213397|CAS-II-A:0.00014)0.673:0.02180)0.998:0.08663,((((
25010966|Streptococcus_agalactiae_NEM316_uid61585|CAS-II-A:0.00016,(
494703076|Sreptococcus_agalactiae_2_22_uid202215|CAS-II-C:0.00402,
410594451|Streptococcus_agalactiae_SA20_06_uid178722|CAS-II-A:0.00014)0.950:0.01216)0.943:0.00812,((
512698373|Streptococcus_agalactiae_ILRI112_uid208675|CAS-II-A:0.00016,
512544671|Streptococcus_agalactiae_ILRI005_uid208676|CAS-II-A:0.01232)0.845:0.00403,(
512539131|Streptococcus_agalactiae_09mas018883_uid208674|CAS-II-A:0.0,
22537058|Streptococcus_agalactiae_2603V_R_uid57943|CAS-II-A:0.0,
76786845|Streptococcus_agalactiae_A909_uid57935|CAS-II-A:0.0,
406709384|Streptococcus_agalactiae_GD201008_001_uid175780|CAS-II-A:0.0):0.00016)0.380:0.00015)1.000:0.08465,(
195978434|Streptococcus_equi_zooepidemicus_MGCS10565_uid59263|CAS-II-A:0.14464,(((((
410494912|Streptococcus_dysgalactiae_equisimilis_AC_2713_uid178644|CAS-II-A:0.0,
386317165|Streptococcus_dysgalactiae_equisimilis_ATCC_12394_uid161979|CAS-II-A:0.0,
251782636|Streptococcus_dysgalactiae_equisimilis_GGS_124_uid59103|CAS-II-A:0.0):0.00838,
408401786|Streptococcus_dysgalactiae_equisimilis_RE378_uid176684|CAS-II-A:0.00016)0.856:0.01016,(
94994318|Streptococcus_pyogenes_MGAS10750_uid58575|CAS-II-A:0.02004,(
209559357|Streptococcus_pyogenes_NZ131_uid59035|CAS-II-A:0.00836,((
410680444|Streptococcus_pyogenes_A20_uid178106|CAS-II-A:0.0,
470200928|Streptococcus_pyogenes_M1_476_uid193766|CAS-II-A:0.0,
15675042|Streptococcus_pyogenes_M1_GAS_uid57845|CAS-II-A:0.0,
94990396|Streptococcus_pyogenes_MGAS10270_uid58571|CAS-II-A:0.0,
94992341|Streptococcus_pyogenes_MGAS2096_uid58573|CAS-II-A:0.0,
21910214|Streptococcus_pyogenes_MGAS315_uid57911|CAS-II-A:0.0,
71910583|Streptococcus_pyogenes_MGAS5005_uid58339|CAS-II-A:0.0,
71903414|Streptococcus_pyogenes_MGAS6180_uid58335|CAS-II-A:0.0,
94988517|Streptococcus_pyogenes_MGAS9429_uid58569|CAS-II-A:0.0,
28896087|Streptococcus_pyogenes_SSI_1_uid57895|CAS-II-A:0.0):0.00014,(
383479947|Streptococcus_pyogenes_MGAS15252_uid158037|CAS-II-A:0.0,
383493862|Streptococcus_pyogenes_MGAS1882_uid158061|CAS-II-A:0.0):0.00413)0.000:0.00014)0.754:0.00535)0.975:0.03415
)1.000:0.10142,(387785883|Streptococcus_mutans_L123_uid162197|CAS-II-A:0.00413,(

FIG. 10N-1

397650021|Streptococcus_mutans_GS_5_uid169223|CAS-II-A:0.00015,
290580221|Streptococcus_mutans_NN2025_uid46353|CAS-II-A:0.00411)0.701:0.00409)0.749:0.00750)0.468:0.00882,
24379808|Streptococcus_mutans_UA159_uid57948|CAS-II-A:0.00524)0.874:0.01345)0.666:0.01704)0.753:0.00958,((
116628212|Streptococcus_thermophilus_LMD_9_uid58327|CAS-II-A:0.0,
386087119|Streptococcus_thermophilus_ND03_uid162015|CAS-II-A:0.0):0.00014,
387910219|Streptococcus_thermophilus_MN_ZLW_002_uid166827|CAS-II-A:0.00411)1.000:0.11027)0.136:0.02044)0.291:0.02445,
389856935|Streptococcus_suis_ST1_uid167482|CAS-II-A:0.12237)0.074:0.03223,
508127400|Streptococcus_iniae_SF1_uid206041|CAS-II-A:0.08708)0.997:0.15469,((
397699067|Enterococcus_faecalis_D32_uid171261|CAS-II-A:0.0,384512369|Enterococcus_faecalis_OG1RF_uid54927|CAS-II-A:0.0
):0.20815,(525919587|Vibrio_parahaemolyticus_O1_K33_CDC_K4557_uid212977|CAS-II-A:0.04747,(
386048323|Listeria_monocytogenes_J0161_uid54459|CAS-II-A:0.00405,((
386044901|Listeria_monocytogenes_10403S_uid54461|CAS-II-A:0.0,
550898769|Listeria_monocytogenes_EGD_uid223288|CAS-II-A:0.0,
404411843|Listeria_monocytogenes_SLCC5850_uid175110|CAS-II-A:0.0):0.00015,(
405756713|Listeria_monocytogenes_SLCC2540_uid175106|CAS-II-A:0.0,
404282158|Listeria_monocytogenes_serotype_1_2b_SLCC2755_uid52455|CAS-II-A:0.0,
404287972|Listeria_monocytogenes_serotype_7_SLCC2482_uid174871|CAS-II-A:0.0,
525888881|Vibrio_parahaemolyticus_O1_K33_CDC_K4557_uid212977|CAS-II-A:0.0,
525927252|Vibrio_parahaemolyticus_O1_K33_CDC_K4557_uid212977|CAS-II-A:0.0):0.00411)0.907:0.00016)0.239:0.02286
)0.993:0.12282)0.962:0.09721)0.552:0.09008)1.000:0.54044,(
374307737|Filifactor_alocis_ATCC_35896_uid46625|CAS-II-A:0.33571,(
169823756|Finegoldia_magna_ATCC_29328_uid58867|CAS-II-A:0.52474,(
534508855|Fusobacterium_3_1_36A2_uid55995|CAS-II-A:0.44260,(479136976|Coprococcus_catus_GD_7_uid197174|CAS-II-A:0.32237,

FIG. 10N-2

```
42525844|Treponema_denticola_ATCC_35405_uid57583|CAS-II-A:0.27775)0.850:0.08752)0.271:0.06226)0.717:0.04743
)0.962:0.14358)0.785:0.08273)0.758:0.10668)0.925:0.09864,
386318631|Staphylococcus_pseudintermedius_ED99_uid162109|CAS-II-C:0.69084)0.936:0.13062,((((
47458867|Mycoplasma_mobile_163K_uid58077|CAS-II-A:0.56290,(
193216853|Mycoplasma_arthritidis_158L3_1_uid58005|part_CAS-II-A:0.51927,(
433625053|Mycoplasma_cynos_C142_uid184824|CAS-II-A:0.17296,(((
401771108|Mycoplasma_gallisepticum_CA06_2006_052_5_2P_uid172630|CAS-II-A:0.0,
401767319|Mycoplasma_gallisepticum_NC95_13295_2_2P_uid172625|CAS-II-A:0.0,
401768091|Mycoplasma_gallisepticum_NC96_1596_4_2P_uid172626|CAS-II-A:0.0,
401768852|Mycoplasma_gallisepticum_NY01_2001_047_5_1P_uid172627|CAS-II-A:0.0,
401766564|Mycoplasma_gallisepticum_VA94_7994_1_7P_uid172624|part_CAS-II-A:0.0,
401769599|Mycoplasma_gallisepticum_W01_2001_043_13_2P_uid172628|CAS-II-A:0.0):0.00385,(
565627374|Mycoplasma_gallisepticum_S6_uid200523|CAS-II-A:0.00012,(
385326555|Mycoplasma_gallisepticum_F_uid162001|CAS-II-A:0.00390,(
385325799|Mycoplasma_gallisepticum_R_high_uid161999|CAS-II-A:0.0,
294660601|Mycoplasma_gallisepticum_R_low_uid57993|CAS-II-A:0.0):0.00014)0.859:0.00396)0.373:0.00010)1.000:0.36179,
71894593|Mycoplasma_synoviae_53_uid58061|CAS-II-A:0.37431)0.868:0.11750)0.996:0.33271)0.988:0.26253)0.985:0.26197,
556591141|Staphylococcus_pasteuri_SP1_uid226267|CAS-II-C:0.63627)0.643:0.10394,(
269123825|Streptobacillus_moniliformis_DSM_12112_uid41863|CAS-II-C:0.77680,(
563693591|Spiroplasma_apis_B31_uid230613|CAS-II-C:0.46694,
507384106|Spiroplasma_syrphidicola_EA_1_uid205054|CAS-II-C:0.38005)0.996:0.32780)0.914:0.16397)0.776:0.10957,(((
386584495|Streptococcus_suis_D9_uid162125|CAS-II-A:0.0,330833103|Streptococcus_suis_ST3_uid66327|CAS-II-A:0.0):0.12726,(
(386338080|Streptococcus_gallolyticus_ATCC_43143_uid162103|CAS-II-A:0.0,
288905631|Streptococcus_gallolyticus_UCN34_uid46061|CAS-II-A:0.0,
374338349|Streptococcus_macedonicus_ACA_DC_198_uid81631|CAS-II-A:0.0,
336064610|Streptococcus_pasteurianus_ATCC_43144_uid68019|CAS-II-A:0.0):0.08762,(((
116627543|Streptococcus_thermophilus_LMD_9_uid58327|CAS-II-A:0.0,
387909442|Streptococcus_thermophilus_MN_ZLW_002_uid166827|CAS-II-A:0.0):0.00410,((
386344354|Streptococcus_thermophilus_JIM_8232_uid162157|CAS-II-A:0.00411,(
55820736|Streptococcus_thermophilus_LMG_18311_uid58219|CAS-II-A:0.00410,
387783793|Streptococcus_salivarius_JIM8777_uid162145|CAS-II-A:0.00821)0.000:0.00014)0.000:0.00014,(
55822628|Streptococcus_thermophilus_CNRZ1066_uid58221|CAS-II-A:0.00014,
386086349|Streptococcus_thermophilus_ND03_uid162015|CAS-II-A:0.00408)0.000:0.00014)0.000:0.00014)1.000:0.11490,((
538370329|Streptococcus_anginosus_C1051_uid218003|CAS-II-A:0.00834,
538380000|Streptococcus_intermedius_B196_uid218000|CAS-II-A:0.00015)0.949:0.02916,(
552737658|Streptococcus_I_G2_uid224251|CAS-II-A:0.01003,
157149930|Streptococcus_gordonii_Challis_substr_CH1_uid57667|CAS-II-A:0.01922)0.986:0.04898)0.947:0.03238)0.873:0.02488
)0.778:0.02268)0.999:0.40821,(479188341|Butyrivibrio_fibrisolvens_uid197155|CAS-II-A:0.26718,
238924076|Eubacterium_rectale_ATCC_33656_uid59169|CAS-II-A:0.31687)0.999:0.42559)0.708:0.15468)0.888:0.16603
)0.488:0.09353)0.644:0.08389,(((517262776|Leptotrichia_shahii|CAS-VI:0.01081,((
544240863|Leptotrichia_wadei_F0279|CAS-VI:0.0,738101037|Leptotrichia_wadei|CAS-VI:0.0):0.00770,
748643056|Leptotrichia_sp__oral_taxon_879|CAS-VI:0.00380)0.672:0.00454)0.987:0.18818,(
545623739|Leptotrichia_wadei|CAS-VI:0.12480,545623305|Leptotrichia_wadei|CAS-VI:0.14463)0.964:0.15247)1.000:0.51906,(
347525458|Lactobacillus_ruminis_ATCC_27782_uid73417|CAS-III-A:0.52707,((
289549397|Staphylococcus_lugdunensis_HKU09_01_uid46233|CAS-III-A:0.00404,
385783005|Staphylococcus_lugdunensis_N920143_uid162143|CAS-III-A:0.00014)0.996:0.21425,(
```

FIG. 10O-1

```
57865886|Staphylococcus_epidermidis_RP62A_uid57663|CAS-III-A:0.05667,(
404477384|Staphylococcus_aureus_08BA02176_uid175257|CAS-III-A:0.01293,
379794576|Staphylococcus_aureus_MSHR1132_uid89393|CAS-III-A:0.02803)0.747:0.03032)0.901:0.08770)0.990:0.33196
)1.000:0.60258)0.894:0.15471)0.611:0.10578,319957207|Nitratifractor_salsuginis_DSM_16511_uid62183|CAS-II-C:0.85069
)0.460:0.10910,(325972002|Spirochaeta_Buddy_uid63633|CAS-II-C:0.66750,(
187250661|Elusimicrobium_minutum_Pei191_uid58949|CAS-II-C:0.35237,
189485060|uncultured_Termite_group_1_bacterium_phylotype_Rs_D17_uid59059|CAS-II-C:0.24504)0.984:0.26475)0.996:0.36651
)0.611:0.08372,471261879|Bdellovibrio_exovorus_JSS_uid194119|CAS-II-C:0.78776)0.798:0.12801,(
294086112|Candidatus_Puniceispirillum_marinum_IMCC1322_uid47081|CAS-II-C:0.79184,((
159042957|Dinoroseobacter_shibae_DFL_12_uid58707|CAS-II-C:0.50798,(
288957740|Azospirillum_B510_uid46085|CAS-II-C:0.27198,(304313028|gamma_proteobacterium_HdN1_uid51635|CAS-II-C:0.6995,(
326315086|Acidovorax_avenae_ATCC_19860_uid42497|CAS-II-C:0.06372,((
319760941|Alicycliphilus_denitrificans_BC_uid49953|CAS-II-C:0.0,
330822846|Alicycliphilus_denitrificans_K601_uid66307|CAS-II-C:0.0)0.05334,
121608212|Verminephrobacter_eiseniae_EF01_2_uid58675|CAS-II-C:0.05608)0.572:0.03162)0.956:0.12599)0.989:0.20382
)0.744:0.07257)0.984:0.22658,(154250554|Parvibaculum_lavamentivorans_DS_1_uid58739|CAS-II-C:0.52666,((
327405118|Fluviicola_taffensis_DSM_16823_uid65271|CAS-II-C:0.33776,((
325955458|Weeksella_virosa_DSM_16922_uid63627|CAS-II-C:0.17686,(
340622235|Capnocytophaga_canimorsus_Cc5_uid70727|CAS-II-C:0.10394,((
383485593|Riemerella_anatipestifer_ATCC_11845__DSM_15868_uid159857|CAS-II-C:0.0,
313206287|Riemerella_anatipestifer_ATCC_11845__DSM_15868_uid60727|part_CAS-II-C:0.0,
442314524|Riemerella_anatipestifer_RA_CH_2_uid186548|CAS-II-C:0.0,
```

FIG. 10O-2

```
386321728|Riemerella_anatipestifer_RA_GD_uid162013 | CAS-II-C:0.0):0.00016,
407451860|Riemerella_anatipestifer_RA_CH_1_uid175469|CAS-II-C:0.01249)0.995:0.13521)1.000:0.22207)1.000:0.35986,(((
390944705|Belliella_baltica_DSM_15883_uid168182|CAS-II-C:0.23098,(
408489715|Psychroflexus_torquis_ATCC_700755_uid54205|CAS-II-C:0.31099,(
392391492|Ornithobacterium_rhinotracheale_DSM_15997_uid168256|CAS-II-C:0.32598,
295136245|Zunongwangia_profunda_SM_A87_uid48073|CAS-II-C:0.20928)0.512:0.05987)0.768:0.06242)0.398:0.05534,
150025576|Flavobacterium_psychrophilum_JIP02_86_uid61627|CAS-II-C:0.16924)0.998:0.20359,((
549484340|Bacteroides_CF50_uid222805|CAS-II-c:0.23548,((375360192|Bacteroides_fragilis_638R_uid84217|CAS-II-C:0.0,
60683388|Bacteroides_fragilis_NCTC_9343_uid57639|CAS-II-C:0.0):0.20776,
387132278|Prevotella_intermedia_17_uid163151|CAS-II-C:0.18123)0.897:0.07623)0.886:0.05977,((
385789536|Fibrobacter_succinogenes_S85_uid161919|CAS-II-C:0.0,
261414554|Fibrobacter_succinogenes_S85_uid41169|CAS-II-C:0.0):0.28732,(
385811610|Ignavibacterium_album_JCM_16511_uid162097|CAS-II-C:0.20382,
397690169|Melioribacter_roseus_P3M_uid170941|part_CAS-II-C:0.24001)0.987:0.12409)0.644:0.04439)0.024:0.07043
)0.159:0.05985)0.837:0.09330)0.794:0.11067,(365959405|Favobacterium_columnare_ATCC_49512_uid80731|CAS-II-C:0.45624,
530892606|Treponema_pedis_T_A4_uid215715|CAS-II-C:0.49629)0.981:0.16784)0.996:0.30554)0.557:0.19870)0.348:0.06678
)0.974:0.20816)0.477:0.01431)0.689:0.19571)0.862:0.33609)0.665:0.27578,((((407464693|Cabdidatus|Casposon:0.03936,(
407462288|Candidatus|Casposon:0.13852,515506733|Notrosopumilus|Casposon:0.03977)0.741:0.04669)1.000:1.11947,((
147921327|Methanocella|Casposon:0.37911,289596068|Aciduliprofundum|Casposon:0.31485)1.000:0.47446,(
518007794|Methanomassiliicoccus_Mx1_Issoire_uid207287|Casposon:0.43025,(432331395|Methanoregula|Casposon:0.26340,((
294495965|Methanohalophilus|Casposon:0.10646,91772593|Methanococcoides|Casposon:0.19581)0.188:0.04125,(
21229351|Methanosarcina|Casposon:0.21679,(410669394|Methanolobus|Casposon:0.06265,
564601588|Methanolobus|Casposon:0.08215)0.998:0.11940)0.998:0.12789)0.942:0.09080)1.000:0.24280)0.110:0.07784
)0.969:0.41096)0.894:0.24535,((325980970|Nitrosomonas|Casposon:0.84311,516886409|Henriciella|Casposon:0.94950
)0.977:0.37772,(374850936|uncultured|Casposon:0.80072,(498380613|Saccharopolyspora|Casposon:0.59188,
514436645|Streptomyces|Casposon:0.90369)0.462:0.19360)0.929:0.26896)0.969:0.30906)0.941:0.24117,(
283778924|Pirellula_staleyi_DSM_6068_uid43209|CAS-III-D:1.48792,((
119720226|Thermofilum_pendens_Hrk_5_uid58563|CAS-III-B_CAS-I-D:0.93956,(
156937861|Ignicoccus_hospitalis_KIN4_I_uid58365|part_CAS-III:0.78162,((
70607609|Sulfolobus_acidocaldarius_DSM_639_uid58379|CAS-I-D:0.0,
449067869|Sulfolobus_acidocaldarius_N8_uid189027|CAS-I-D:0.0,
449070141|Sulfolobus_acidocaldarius_Ron12_I_uid189028|CAS-I-D:0.0):0.31626,(
385772765|Sulfolobus_islandicus_HVE10_4_uid162067|CAS-I-D:0.0,
479325027|Sulfolobus_islandicus_LAL14_1_uid197216|CAS-III-B_CAS-ID:0.0):0.25694)0.950:0.27339)0.888:0.25590
)0.998:0.74894,((124485266|Methanocorpusculum|SOLO:0.58634,((307352568|Methanolacinia|SOLO:0.575374,(
126178701|Methanoculleus|SOLO:0.07468,397780289|Methanoculleus|SOLO:0.13190)0.997:0.29685)0.690:0.09248,(
154150254|Methanoregular|SOLO:0.49519,219852754|Methanosphareula|SOLO:0.44594)0.052:0.05901)0.918:0.16958)1.000:1.12342,(
(50085564|Acinetobacter_ADP1_uid61597|CAS0I-F:0.47110,((
77166205|Nitrosococcus_oceani_ATCC_19707_uid58403|CAS-I-F:0.00754,(
292491305|Nitrosococcus_halophilus_Nc4_uid46803|CAS-I-F:0.08039,
300115372|Nitrosococcus_watsonii_c_113_uid50331|CAS-I-F:0.02997)0.335:0.00998)1.000:0.43993,(((
436842170|Desulfovibrio_hydrothermalis_AM13__DSM_14728_uid184831|CAS-I-F:0.0,
551596054|Desulfovibrio_hydrothermalis_AM13__DSM_14728_uid184831|CAS-I-F:0.0):0.29403,((
297569499|Desulfurivibrio_alkaliphilus_AHT2_uid49487|CAS-I-F:0.18201,((
375259960|Klebsiella_oxytoca_KCTC_1686_uid83159|CAS-I-F:0.11291,((
218688665|Escherichia_coli_ED1a_uid59379|CAS-I-F:0.00016,((117623062|Escherichia_coli_APEC_O1_uid58623|CAS-I-F:0.0,
```

FIG. 10P-1

386598616|Escherichia_coli_IHE3034_uid162007|part_CAS-I-F:0.0,222155607|Escherichia_coli_LF82_uid161965|CAS-I-F:0.0,
387616140|Escherichia_coli_O83_H1_NRG_857C_uid161987|CAS-I-F:0.0,544575281|Escherichia_coli_PMV_1_uid219679|CAS-I-IF:0.0,
218557787|Escherichia_coli_S88_uid62979|part_CAS-I-F:0.0):0.00014,(
386605207|Escherichia_coli_UM146_uid162043|part_CAS-I-F:0.0,91209921|Escherichia_coli_UTI89_uid58541|CAS-I-F:0.0
):0.00400)0.904:0.01201)1.000:0.14519,146311059|Enterobacter_638_uid58727|CAS-I-F:0.12514)0.323:0.02414)0.998:0.19074,(
237808119|Tolumonas_auensis_DSM_9187_uid59395|CAS-I-F:0.15114,(((
440229170|Serratia_marcescens_FGI94_uid185180|CAS-I-F:0.07150,(
383189738|Rahnella_aquatilis_CIP_78_65__ATCC_33071_uid86855|CAS-I-F:0.14426,((
387870253|Erwinia_pyrifoliae_DSM_12163_uid159693|CAS-I-F:0.0,259907498|Erwinia_pyrifoliae_Ep1_96_uid40659|CAS-I-F:0.0
):0.01194,188532985|Erwinia_tasmaniensis_Et1_99_uid59029|CAS-I-F0.01391)0.003:0.80920)0.809:0.02311)0.948:0.04028,(
541866180|Serratia_ATCC_39006_uid218470|CAS-I-F:0.03820,((307132487|Dickeya_dadantii_3937_uid52537|CAS-I-F:0.02525,(
242238166|Dickeya_dadantii_Ech703_uid59363|CAS-I-F:0.01270,(271501957|Dickeya_dadantii_Ech586_uid42519|CAS-I-F:0.00016,
251788335|Dickeya_zeae_Ech1591_uid59297|CAS-I-F:0.01635)0.879:0.00807)0.747:0.00379)1.000:0.06000,(
403059938|Pectobacterium_carotovorum_PCC21_uid174335|CAS-I-F:0.00550,((
470156230|Pectobacterium_scc3191_uid193707|CAS-I-F:0.00014,
261822895|Pectobacterium_wasabiae_WPP163_uid41297|CAS-I-F:0.00409)0.940:0.01718,
50122600|Pectobacterium_atrosepticum_SCR1043_uid57957|CAS-I-F:0.01186)0.239:0.00419)0.943:0.02505)0.406:0.00502
)0.999:0.09228)0.224:0.01664,(253990199|Photorhabdus_asymbiotica_ATCC_43949_uid59243|CAS-I-F:0.05719,((
384139707|Yersinia_pestis_A1122_uid158119|CAS-I-F:0.0,162418150|Yersinia_pestis_Angola_uid58485|CAS-I-F:0.0,
108807960|Yersinia_pestis_Antiqua_uid58607|CAS-I-F:0.0,218929557|Yersinia_pestis_CO92_uid57621|CAS-I-F:0.0,
384122748|Yersinia_pestis_D106004_uid158071|CAS-I-F:0.0,384126682|Yersinia_pestis_D182038_uid158073|CAS-I-F:0.0,
22125615|Yersinia_pestis_KIM_10_uid57875|CAS-I-F:0.0,108812225|Yersinia_pestis_Nepal516_uid58609|CAS-I-F:0.0,

FIG. 10P-2

```
145599164|Yersinia_pestis_Pestoides_F_uid58619|CAS-I-F:0.0,294504227|Yersinia_pestis_Z176003_uid47317|CAS-I-F:0.0,
384414198|Yersinia_pestis_biovar_Medievalis_Harbin_35_uid158537|CAS-I-F:0.0,
45442077|Yersinia_pestis_biovar_Microtus_91001_uid58037|CAS-I-F:0.0):0.00015,((
51596831|Yersinia_pseudotuberculosis_IP_32953_uid58157|CAS-I-F:0.0,
186895909|Yersinia_pseudotuberculosis_PB1_uid59153|CAS-I-F:0.0):0.00406,(
153949474|Yersinia_pseudotuberculosis_IP_31758_uid58487|CAS-I-F:0.0,
170023885|Yersinia_pseudotuberculosis_YPIII_uid59151|CAS-I-F:0.0):0.00014)0.832:0.00403)0.999:0.07856)0.029:0.01863
)0.903:0.0495)0.787:0.06088)0.924:0.08186)0.971:0.09264,(((((
307543692|Halomonas_elongata_DSM_2581_uid52781|CAS-I-F:0.11355,((
386058681|Pseudomonas_aeruginosa_M18_uid162089|CAS-I-F:0.00411,
568309632|Pseudomonas_aeruginosa_SCV20265_uid232358|CAS-I-F:0.00015)0.802:0.00767,(
392984024|Pseudomonas_aeruginosa_DK2_uid168996|CAS-I-F:0.00015,
116050364|Pseudomonas_aeruginosa_UCBPP_PA14_uid57977|CAS-I-F:0.00411)0.750:0.00486)1.000:0.15800)0.904:0.04168,
545642074|Desulfovibrio_gigas_DSM_1382_uid221293|CAS-I-F:0.23502)0.688:0.00442,(
430761718|Thioalkalivibrio_nitratireducens_DSM_14787_uid184011|CAS-I-F:0.12882,
289209607|Thioalkalivibrio_K90mix_uid46181|CAS-I-F:0.16203)0.090:0.02695)0.932:0.04954,(((
397676481|Zymomonas_mobilis_ATCC_29191_uid170612|CAS-I-F:0.00016,((
384411531|Zymomonas_mobilis_ATCC_10988_uid55403|CAS-I-F:0.00829,(
283856307|Zymomonas_mobilis_ZM4_uid58095|CAS-I-F:0.00014,
560136521|Zymomonas_mobilis_CP4___NRRL_B_14023_uid229874|CAS-I-F:0.00407)0.788:0.00411)0.779:0.00410,
260752826|Zymomonas_mobilis_NCIMB_11163_uid41019|CAS-I-F:0.00832)0.740:0.00413)1.000:0.16245,((
285019808|Xanthomonas_albilineans_GPE_PC73_uid43163|CAS-I-F:0.08350,
384429891|Xanthomonas_campestris_raphani_756C_uid159539|CAS-I-F:0.08533)0.908:0.05511,(
121608431|Verminephrobacter_eiseniae_EF01_2_uid58675|CAS-I-F:0.09772,(
121592920|Acidovorax_JS42_uid58427|CAS-I-F:0.05489,(333916900|Delftia_Cs1_4_uid67319|CAS-I-F:0.00015,
160895567|Delftia_acidovorans_SPH_1_uid58703|CAS-I-F:0.00835)0.992:0.06286)0.966:0.05327)0.974:0.06704)0.135:0.02379
)0.919:0.047791,34497211|Chromobacterium_violaceum_ATCC_12472_uid58001|CAS-I-F:0.13677)0.236:0.03034)0.086:0.03526,(
239908820|Desulfovibrio_magneticus_RS_1_uid59309|CAS-I-F:0.25502,(
387120332|Aggregatibacter_actinomycetemcomitans_D7S_1_uid46989|CAS-I-F:0.16893,((
165975670|Actinobacillus_pleuropneumoniae_serovar_3_JL03_uid58891|CAS-I-F:0.0,
126207702|Actinobacillus_pleuropneumoniae_serovar_5b_L20_uid58789|CAS-I-F:0.0,
190149485|Actinobacillus_pleuropneumoniae_serovar_7_AP76_uid59231|CAS-I-F:0.0):0.14827,((
386834577|Pasteurella_multocida_3480_uid161955|CAS-I-F:0.0,383309947|Pasteurella_multocida_HN06_uid156881|CAS-I-F:0.0
):0.00417,(378774028|Pasteurella_multocida_36950_uid86887|CAS-I-F:0.0,
15602176|Pasteurella_multocida_Pm70_uid57627|CAS-I-F:0.0):0.00014)0.991:0.08811)0.835:0.03585)1.000:0.21309
)0.921:0.05897)0.318:0.03736,317051111|Desulfurispirillum_indicum_S5_uid45897|CAS-I-F:0.18134)0.398:0.03135
)0.865:0.07254)0.989:0.13823,((479197419|Taylorella_equigenitalis_14_56_uid197193|CAS-I-F:0.00016,(
479191878|Taylorella_asinigenitalis_14_45_uid197194|CAS-I-F:0.00408,
348589565|Taylorella_asinigenitalis_MCE3_uid73771|part_CAS-I-F:0.00820)0.936:0.01673)1.000:0.33803,(((
330837112|Spirochaeta_coccoides_DSM_17374_uid66331|CAS-I-F:0.26410,
383789641|Spirochaeta_africana_DSM_8902_uid81779|CAS-I-F:0.22459)0.939:0.07233,(
348027012|Megasphaera_elsdenii_DSM_20460_uid71135|CAS-I-F:0.21187,
383753766|Selenomonas_ruminantium_lactilytica_TAM6421_uid157247|CAS-I-F:0.17300)0.931:0.05712)0.812:0.02189,((((
212213313|Coxiella_burnetii_CbuG_Q212_uid58893|part_CAS-I-F:0.00807,
209364215|Coxiella_burnetii_Dugwau_5J108_111_uid58629|CAS-I-F:0.00401)0.999:0.16022,
521179933|Psychrobacter_G_uid210641|CAS-I-F:0.26146)0.943:0.06925,(((
```

FIG. 10Q-1

```
296106563|Legionella_pneumophila_2300_99_Alcoy_uid48801|part_CAS-I-F:0.10928,(
54292958|Legionella_pneumophila_Lens_uid58209|CAS-I-F:0.00015,
54295747|Legionella_pneumophila_Lens_uid58209|CAS-I-F:0.00416)0.945:0.05482)0.992:0.09687,(
387128443|Methylophaga_JAM1_uid162947|part_CASE-I-F:0.07082,387130001|Methylophaga_JAM7_uid162949|CAS-I-F:0.08572
)0.764:0.04656)0.986:0.09635,(386744974|Providencia_stuartii_MRSN_2154_uid162193|CAS-I-F:0.14889,(((
153001750|Shewanella_baltica_OS185_uid58743|CAS-I-F:0.0,160876483|Shewanella_baltica_OS195_uid58261|CAS-I-F:0.0,
378709684|Shewanella_baltica_OS678_uid50553|CAS-I-F:0.0):0.00822,((120598999|Shewanella_W3_18_1_uid58341|CAS-I-F:0.0,
146292917|Shewanella_putrefaciens_CN_32_uid58267|part_CAS-I-F:0.0):0.00014,
386313929|Shewanella_putrefaciens_200_uid161927|part_CAS-I-F:0.00802)0.846:0.00802)0.983:0.06353,(
326796560|Marinomonas_mediterranea_MMB_1_uid64753|CAS-I-F:0.09406,
54303647|Photobacterium_profundum_SS9_uid62923|part_CAS-I-F:0.11283)0.404:0.03453)0.821:002093)0.996:0.11477
)0.284:0.01852)0.970:0.07453,(333983108|Methylomonas_methanica_MC09_uid67363|CAS-I-F:0.13959,(
296112254|Moraxella_catarrhalis_BBH18_uid48809|CAS-I-F:0.23844,(
213158189|Acinetobacter_baumannii_AB0057_uid59083|CAS-I-F:0.0,
215482695|Acinetobacter_baumannii_AB307_0294_uid59271|CAS-I-F:0.0,
169795149|Acinetobacter_baumannii_AYE_uid61637|CAS-I-F:0.0):0.15050)0.855:0.05961)0.785:0.03568)0.594:0.03021
)0.875:0.04762)0.976:0.12935)0.953:0.12052)0.734:0.18844)0.996:0.996:0.65979,((((
397652782|Corynebacterium_ulcerans_0102_uid169879|CAS-I-E:0.0,
384514575|Corynebacterium_ulcerans_809_uid159659|CAS-I-E:0.0,
337289649|Corynebacterium_ulcerans_BR_AD22_uid68291|CAS-I-E:0.0):0.00501,((
389851004|Corynebacterium_pseudotuberculosis_258_uid167260|part_CAS-I-E:0.0,
379715956|Corynebacterium_pseudotuberculosis_316_uid89381|part_CAS-I-E:0.0):0.00014,
```

FIG. 10Q-2

```
392401162|Corynebacterium_pseudotuberculosis_Cp162_uid168258|part_CAS-I-E:0.00498)0.861:0.02036)0.919:0.15308,(
297572289|Arcanobacterium_haemolyticum_DSM_20595_uid49489|CAS-I-E:0.23173,(
375291817|Corynebacterium_diphtheriae_241_uid83607|CAS-I-E:0.0,
376246654|Corynebacterium_diphtheriae_HC01_uid84297|CAS-I-E:0.0,
38234755|Corynebacterium_diphtheriae_NCTC_13129_uid57691|CAS-I-E:0.0):0.18465)0.988:0.23365)0.992:0.50268,(((
269125200|Thermomonospora_curvata_DSM_43183_uid41885|CAS-I-B_CAS-I-E:0.26227,(
159037600|Salinispora_arenicola_CNS_205_uid58659|CAS-I-E:0.20495,(
357393350|Kitasatospora_setae_KM_6054_uid77027|part_CAS-I-E:0.15063,
29834079|Streptomyces_avermitilis_MA_4680_uid57739|CAS-I-E:0.11286)0.11286)0.986:0.12531)0.491:0.07843)0.917:0.12191,(
257055744|Saccharomonospora_viridis_DSM_43017_uid59055|CAS-I-E_CAS-I-E:0.20689,
72161989|Thermobifida_fusca_YX_uid57703|CAS-III-B_CAS-I-E_CAS-I-E:0.41851)0.541:0.12057)0.681:0.12654,(((((
357387505|Kitasatospora_setae_KM_6054_uid77027|CAS-I-E:0.11671,
257055753|Saccharomonospora_viridis_DSM_43017_uid59055|CAS-I-E_CAS-I-E:0.13553)0.905:0.08772,(
410867500|Propionibacterium_acidipropionici_ATCC_4875_uid179069|CAS-I-E:0.25158,(
86738746|Frankia_CcI3_uid58397|CAS-I-E:0.13138,111219951|Frankia_alni_ACN14a_uid58695|CAS-I-E:0.03224)0.978:0.11183
)0.762:0.09432)0.999:0.27479,(256371771|Acidimicrobium_ferrooxidans_DSM_10331_uid59215|CAS-I-E:0.43305,(((((((
159038158|Salinispora_arenicola_CNS_205_uid58659|CAS-I-E:0.08393,
330467207|Verrucosispora_maris_AB_18_032_uid66297|CAS-I-E:0.07392)0.999:0.18072,((
386070350|Propionibacterium_acnes_ATCC_11828_uid162177|CAS-I-E:0.07597,
480328237|Propionibacterium_avidum_44067_uid197361|CAS-I-E:0.04307)1.000:0.34817,(
297560256|Nocardiopsis_dassonvillei_DSM_43111_uid49483|CAS-I-E:0.16971,(((
479324015|Streptomyces_PAMC26508_uid197217|CAS-I-E:0.00767,
357409215|Streptomyces_flavogriseus_ATCC_33331_uid40839|CAS-I-E:0.00913)0.984:0.07561,(
557689675|Streptomyces_rapamycinicus_NRRL_5491_uid227224|part_CAS-I-E:0.06660,(
386835890|Streptomyces_hygroscopicus_jinggangensis_5008_uid89409|CAS-I-E:0.0,
474987208|Streptomyces_hygroscopicus_jinggangensis_TL01_uid189753|CAS-I-E:0.0):0.13599)0.296:0.01809)0.965:0.07562,((
296269507|Thermobispora_bispora_DSM_43833_uid48999|CAS-I-E:0.07865,
269126905|Thermomonospora_curvata_DSM_43183_uid41885|CAS-I-E:0.09936)0.986:0.10460,(
256393069|Catenulispora_acidiphila_DSM_44928_uid59077|CAS-I-E:0.16268,
182437340|Streptomuces_griseis_NBRC_13350_uid58983|CAS-I-E:0.14968)0.771:0.04236)0.900:0.04924)0.901:0.05597
)1.000:0.23268)0.900:0.04654)0.910:0.06392,(332669040|Cellulomonas_fimi_ATCC_484_uid66779|CAS-I-E:0.17072,
54026395|Nocardia_farcinica_IFM_10152_uid58203|CAS-I-E:0.23323)0.683:0.05258)0.714:0.04766,(
258653218|Nakamurella_multipartita_DSM_44233_uid59221|CAS-I-E:0.15601,
433603791|Saccharothrix_espanaensis_DSM_44229_uid184826|CAS-I-E:0.19293)0.748:0.04490)0.920:0.04773,(
386867543|Bifidobacterium_animalis_ATCC_25527_uid162513|CAS-I-E:0.05511,
312134081|Bifidobacterium_longum_BBMN68_uid60163|CAS-I-E:0.13319)1.000:0.32389)0.911:0.06360,(
521190019|Corynebacterium_terpenotabodum_Y_11_uid210639|CAS-I-E:0.34682,((
408501645|Bifidobacterium_asteroides_PRL2011_uid176921|CAS-I-E:0.15800,
328955026|Coriobacterium_glomerans_PW2_uid65787|CAS-I-E:0.18470)0.984:0.12042,(
479212169|Eubacterium_siraeum_V10Sc8a_uid197178|CAS-I-E:0.30924,(((
283783235|Gardnerella_vaginalis_409_05_uid43211|CAS-I-E:0.03160,
311114560|Gardnerella_vaginalis_ATCC_14019_uid55487|CAS-I-E:0.00715)1.000:0.21036,(
340398858|Streptococcus_salivarius_CCHSS3_uid70481|CAS-I-E:0.10650,(
397650106|Streptococcus_mutans_GS_5_uid169223|part_CAS-I-E:0.00016,
290580135|Streptococcus_mutans_NN2025_uid46353|CAS-I-E:0.00974)0.990:0.08364)0.954:0.07397)0.998:0.14138,(((
```

FIG. 10R-1

```
385817592|Lactobacillus_amylovorus_GRL1118_uid160233|CAS-I-E:0.13764,((
385812192|Lactobacillus_fermentum_CECT_5716_uid162003|part_CAS-I-E:0.0,
184155173|Lactobacillus_fermentum_IFO_3956_uid58865|CAS-I-E:0.0):0.16808,(
501675107|Lactobacillus_fermentum_F6_uid203391|CAS-I-E:0.14185,(
295693070|Lactobacillus_crispatus_ST1_uid48359|CAS-I-E:0.18034,((
104773928|Lactobacillus_delbrueckii_bulgaricus_ATCC_11842_uid58647|CAS-I-E:0.0,
116513937|Lactobacillus_delbrueckii_bulgaricus_ATCC_BAA_365_uid57987|CAS-I-E:0.0):0.00713,
313123566|Lactobacillus_delbrueckii_bulgaricus_ND02_uid60621|CAS-I-E:0.01281)0.999:0.15424)0.330:0.02016)0.209:0.02910
)0.078:0.02147)0.948:0.06081,406025970|Lactobacillus_buchneri_uid73657|CAS-I-E:0.16864)0.908:0.06069,
116493922|Lactobacillus_casei_ATCC_334_uid57985|CAS-I-E:0.15775)0.971:0.08738)0.973:0.09977)0.750:0.06659)0.948:0.08975
)0.343:0.04387)0.451:0.02007,(68535718|Corynebacterium_jeikeium_K411_uid58399|CAS-I-E:0.24341,((
298345382|Mobiluncus_curtisii_ATCC_43063_uid49695|part_CAS-I-E:0.12499,(
376241738|Corynebacterium_diphtheriae_CDCE_8392_uid84295|CAS-I-E:0.01450,(
376253164|Corynebacterium_diphtheriae_PW8_uid84303|CAS-I-E:0.00485,((
376250212|Corynebacterium_diphtheriae_HC03_uid84299|CAS-I-E:0.0,
376247407|Corynebacterium_diphtheriae_HC04_uid84301|CAS-I-E:0.0):0.00014,
375292015|Corynebacterium_diphtheriae_INCA_402_uid83605|CAS-I-E:0.00481)0.860:0.00486)0.848:0.00015)0.960:0.06429
)0.993:0.14290,((172041644|Corynebacterium_urealyticum_DSM_7109_uid61639|CAS-I-E:0.01751,
448824549|Corynebacterium_urealyticum_DSM_7111_uid188688|CAS-I-E:0.04881)1.000:0.14332,(
227832732|Corynebacterium_aurimucosum_ATCC_700975_uid59409|CAS-I-E:0.07113,
336326623|Corynebacterium_resistens_DSM_45100_uid50555|CAS-I-E:0.12603)0.909:0.06511)0.286:0.06233)0.802:0.06954
)1.000:0.25467)0.774:0.07882)0.563:0.09183)0.871:0.09293,((
218782762|Desulfatibacillum_alkenivorans_AK_01_uid58913|CAS-I-E:0.15320,(((
```

FIG. 10R-2

```
227116690|Vibrio_cholerae_O395_uid159869|CAS-I-E:0.0,147674033|Vibrio_cholerae_O395_uid58425|CAS-I-E:0.0):0.11659,(
251788543|Dickeya_zeae_Ech1591_uid59297|CAS-I-E:0.02843,(402780419|Klebsiella_pneumoniae_1084_uid174151|CAS-I-E:0.0,
238895125|Klebsiella_pneumoniae_NTUH_K2044_uid59073|CAS-I-E:0.0):0.07471)0.167:0.04121)0.990:0.12710,(
21674788|Chlorobium_tepidum_TLS_uid57897|CAS-I-E:0.20708,(
189501080|Chlorobium_phaeobacteroides_BS1_uid58131|CAS-I-E:0.03641,
194334221|Prosthecochloris_aestuarii_DSM_271_uid58151|CAS-I-E:0.01044)0.945:0.07704)0.989:0.14116)0.980:0.10748
)0.613:0.06324,330837093|Spirochaeta_coccoides_DSM_17374_uid66331|CAS-I-E:0.18569)1.000:0.71487)0.363:011211,(((
220909452|Cyanothece_PCC_7425_uid59435|CAS-I-E:0.20979,(86605441|Synechococcus_JA_3_3Ab_uid58535|CAS-I-E:0.23141,
218439403|Cyanothece_PCC_7424_uid59025|CAS-I-E:0.17225)0.644:0.08222)0.999:0.22660,(((
147920423|Methanocella_arvoryzae_MRE50_uid61623|CAS-I-E:0.38780,(
269929332|Sphaerobacter_thermophilus_DSM_20745_uid41997|CAS-I-E:0.17074,(
51891801|Symbiobacterium_thermophilum_IAM_14863_uid58165|CAS-I-E:0.21058,(
148654810|Roseiflexus_RS_1_1uid58523|CAS-I-E:0.19190,
269838937|Thermobaculum_terrenum_ATCC_BAA_798_uid42011|CAS-I-E:0.22473)0.745:0.05895)0.914:0.07557)0.416:0.04078
)0.859:0.04599,167628317|Heliobacterium_modesticaldum_Ice1_uid58279|CAS-I-E:0.37672)0.161:0.01831,(((
297624524|Truepera_radiovictrix_DSM_17093_uid49533|CAS-I-E:0.13623,((
482883105|Meiothermus_ruber_DSM_1279_uid198526|CAS-I-E:0.0,291297379|Meiothermus_ruber_DSM_1279_uid466661|CAS-I-E:0.0
):0.03961,297565669|Meiothermus_silvanus_DSM_9946_uid49485|CAS-I-E:0.05207)0.872:0.872:0.08781)0.925:0.09623,((
55978376|Thermus_thermophilus_HB8_uid58223|CAS-I-E:0.00531,
386361489|Thermus_thermophilus_JL_18_uid162129|CAS-I-E:0.00014),(
328950501|Marinithermus_hydrothermalis_DSM_14884_uid65783|CAS-I-E:0.08559,(
410732171|Thermus_oshimai_JL_2_uid178948|CAS-I-E:0.08582,320450318|Thermus_scotoductus_SA_01_uid62273|CAS-I-E:0.09240
)0.824:0.05586)0.874:0.05325)0.999:0.22807)0.931:0.08417,(
325284857|Deinococcus_proteolyticus_MRP_uid63399|part_CASE-I-E:0.24683,(
94972104|Deinococcus_geothermalis_DSM_11300_uid58275|CAS-I-E:0.07436,
386855142|Deinococcus_gobiensis_I_0_uid162509|CAS-I-E:0.07575)0.992:0.16498)1.000:0.28970)0.922:0.06568)0.937:0.08835
)0.123:0.04740,(((116331946|Leptospira_borgpetersenii_serovar_Hardjo_bovis_JB197_uid58509|CAS-I-E:0.0,
116327441|Leptospira_borgpetersenii_serovar_Hardjo_bovis_L550_uid58507|CAS-I-E:0.0):0.36865,(
452204203|Dehalococcoides_mccartyi_DCMB5_uid190184|CAS-I-E:0.00014,(
73749217|Dehalococcoides_CBDB1_uid58413|CAS-I-E:0.00402,289433192|Dehalococcoides_GT_uid42115|CAS-I-E:0.00471
)0.979:0.00169)1.000:0.40959)0.804:0.11078,(220904201|Desulfovibrio_desulfuricans_ATCC_27774_uid59213|CAS-I-E:0.25860,((
(219852205|Methanosphaerula_palustris_E1_9c_uid59193|CAS-I-E:0.17330,(
91772628|Methanococcoides_burtonii_DSM_6242_uid58023|CAS-I-E:0.07025,
336477473|Methanosalsum_zhilinae_DSM_4017_uid68249|CAS-I-E:0.14603)1.000:0.14105)0.944:0.07040,((
88602656|Methanospirillum_hungatei_JF_1_uid58181|CAS-I-E:0.29358,((
83591509|Rhodospirillum_rubrum_ATCC_11170_uid57655|CAS-I-E_CAS-III-D:0.0,
386348188|Rhodospirillum_rubrum_F11_uid162149|CAS-I-E_CAS-III-D:0.0):0.08971,
338707995|Zymomonas_mobilis_pomaceae_ATCC_29192_uid68445|CAS-I-E:0.09556)0.997:0.13799)0.499:0.02695,((
220925254|Methylobacterium_nodulans_ORS_2060_uid59023|CAS-I-E:0.13629,
384262419|Rhodospirillum_photometricum_uid159003|CAS-I-E:0.18686)0.921:0.06814,((
148243835|Acidiphilium_cryptum_JF_5_uid58447|CAS-I-E:0.0,148260802|Acidiphilium_cryptum_JF_5_uid58447|CAS-I-E:0.0
):0.16677,(414341117|Gluconobacter_oxydans_H24_uid179202|CAS-I-E:0.12715,(
347759998|Gluconacetobacter_xylinus_NBRC_3288_uid46523|CAS-I-E:0.07024,((
384117649|Acetobacter_pasteurianus_IFO_3283_01_42C_uid158377|CAS-I-E:0.0,
```

FIG. 10S-1

```
258513018|Acetobacter_pasteurianus_IFO_3283_01_uid59279|CAS-I-E:0.0,
384049465|Acetobacter_pasteurianus_IFO_3283_03_uid158373|CAS-I-E:0.0,
384055396|Acetobacter_pasteurianus_IFO_3283_07_uid158381|CAS-I-E:0.0,
384043999|Acetobacter_pasteurianus_IFO_3283_12_uid158379|CAS-I-E:0.0,
384055813|Acetobacter_pasteurianus_IFO_3283_22_uid158383|CAS-I-E:0.0,
384061324|Acetobacter_pasteurianus_IFO_3283_26_uid158531|CAS-I-E:0.0,
384061684|Acetobacter_pasteurianus_IFO_3283_32_uid158375|CAS-I-E:0.0):0.03733,(
209542604|Gluconacetobacter_diazotrophicus_PAl_5_uid59075|CAS-I-E:0.0,
162147988|Gluconacetobacter_diazotrophicus_PAl_5_uid61587|CAS-I-E:0.0):0.05250)0.462:0.03710)0.954:0.954:0.05944)0.930:0.08033
)0.631:0.04520)0.906:0.06807)0.869:0.06518)0.539:0.02285,((
392412844|Desulfomonile_tiedjei_DSM_6799_uid168320|CAS-I-E:0.15245,
114328039|Granulibacter_bethesdensis_CGDNIH1_uid58661|CAS-I-E:0.18352)0.919:0.05169,(((
116750256|Synthrophobacter_fumaroxidans_MPOB_uid58177|CAS-I-E:0.16734,(
404492576|Pelobacter_carbinolicus_DSM_2380_uid58241|CAS-I-E:0.06170,((
409911919|Geobacter_sulfurreducens_KN400_uid161977|CAS-I-E:0.00014,
39996494|Geobacter_sulfurreducens_PCA_uid57743|CAS-I-E:0.00523)0.944:0.03574,(
148262910|Geobacter_uraniireducens_Rf4_uid58475|CAS-I-E:0.05085,(
189425531|Geobacter_lovleyi_SZ_uid58713|CAS-I-E:0.02402,
118580752|Pelobacter_propionicus_DSM_2379_uid58255|CAS-I-E:0.03201)0.942:0.02854)0.922:0.03359)0.920:0.04684
)0.941:0.06135)0.889:0.03481,(383756542|Rubrivivax_gelatinosus_IL144_uid158163|CAS-I-E:0.13671,(((
300114059|Nitrosococcus_watsonii_C_113_uid50331|part_CAS-I-E:0.10325,
357407021|Methylomicrobium_alcaliphilum_uid77119|part_CAS-I-E:0.16052)0.879:0.04895,(
288940368|Allochromatium_vinosum_DSM_180_uid46083|CAS-I-E:0.02643,
390948892|Thiocystis_violascens_DSM_198_uid74025|CAS-I-E:0.02183)0.997:0.08968)0.330:0.01012,((
```

FIG. 10S-2

```
529065662 | Cycloclasticus_zancles_7_ME_uid214092 | CAS-I-E:0.11139,((((
260596842 | Cronobacter_turicensis_z3032_uid40821 | CAS-I-E:0.01042,(
565646473 | Cronobacter_sakazakii_45402_uid231516 | CAS-I-E:0.00014,(
156934981 | Cronobacter_sakazakii_ATCC_BAA_894_uid58145 | CAS-I-E:0.0,
389841918 | Cronobacter_sakazakii_ES15_uid167045 | CAS-I-E:0.0,449309209 | Cronobacter_sakazakii_Sp291_uid189241 | CAS-I-E:0.0
):0.00524)0.883:0.00016)0.998:0.07415,(283786691 | Citrobacter_rodentium_ICC168_uid43089 | CAS-I-E:0.01236,((
529989706 | Klebsiella_pneumoniae_uid203334|CAS-I-E:0.03181,(((
340000487 | Salmonella_bongori_NCTC_12419_uid70155 | part_CAS-I-E:0.0,
526228911 | Salmonella_bongori_Sbon_167_uid213088 | CAS-I-E:0.0):0.01440,((
525858716 | Salmonella_enterica_Serovar_Cubana_CFSAN002050_uid212973 | CAS-I-E:0.0,
563654284 | Salmonella_enterica_serovar_Agona_24249_uid230614 | CAS-I-E:0.0,
197248534 | Salmonella_enterica_serovar_Agona_SL483_uid59431 | CAS-I-E:0.0,
525946308 | Salmonella_enterica_serovar_Bareilly_CFSAN000189_uid212971 | CAS-I-E:0.0,
62181440 | Salmonella_enterica_serovar_Choleraesuis_SC_B67_uid58017 | part_CAS-I-E:0.0,
198243044 | Salmonella_enterica_serovar_Dublin_CT_02021853_uid58917 | CAS-I-E:0.0,
207858198 | Salmonella_enterica_serovar_Enteritidis_P125109_uid59247 | CAS-I-E:0.0,
205353879 | Salmonella_enterica_serovar_Gallinarum_287_91_uid59249 | CAS-I-E:0.0,
537438123 | Salmonella_enterica_serovar_Gallinarum_Pullorum_CDC1983_67_uid217770 | CAS-I-E:0.0,
378956558 | Salmonella_enterica_serovar_Gallinarum_pullorum_RKS5078_uid87035 | CAS-I-E:0.0,
224584717 | Salmonella_enterica_serovar_Paratyphi_C_RKS4594_uid59063 | CAS-I-E:0.0,
549480362 | Salmonella_enterica_serovar_Thompson_RM6836_uid222802 | CAS-I-E:0.0):0.00016,((
525829217 | Salmonella_enterica_Serovar_Heidelberg_CFSAN002069_uid212974 | CAS-I-E:0.0,
525837161 | Salmonella_enterica_Serovar_Typhimurium_var__5__CFSAN001921_uid212972 | CAS-I-E:0.0,
525814200 | Salmonella_enterica_serovar_Heidelberg_41578_uid212970 | CAS-I-E:0.0,
386592622 | Salmonella_enterica_serovar_Heidelberg_B182_uid162195 | CAS-I-E:0.0,
194448225 | Salmonella_enterica_serovar_Heidelberg_SL476_uid58973 | CAS-I-E:0.0,
16766244 | Salmonella_enterica_serovar_Typhimurium_LT2_uid57799 | CAS-I-E:0.0,
378985528 | Salmonella_enterica_serovar_Typhimurium_T000240_uid84397 | CAS-I-E:0.0,
482905499 | Salmonella_enterica_serovar_Typhimurium_U288_uid198746 | CAS-I-E:0.0,
550902303 | Salmonella_typhimurium_DT104_uid223287 | CAS-I-E:0.0):0.00014,(
526221346 | Salmonella_enterica_serovar_4_5_12_i__08_1736_uid212969 | CAS-I-E:0.0,
378451691 | Salmonella_enterica_serovar_Typhimurium_14028S_uid86059 | CAS-I-E:0.0,
383497609 | Salmonella_enterica_serovar_Typhimurium_798_uid158047 | CAS-I-E:0.0,
378446294 | Salmonella_enterica_serovar_Typhimurium_D23580_uid86061 | CAS-I-E:0.0,
549725508 | Salmonella_enterica_serovar_Typhimurium_DT2_uid222818 | CAS-I-E:0.0,
378700849 | Salmonella_enterica_serovar_Typhimurium_SL1344_uid86645 | CAS-I-E:0.0,
379702192 | Salmonella_enterica_serovar_Typhimurium_ST4_74_uid84393 | CAS-I-E:0.0,
378990262 | Salmonella_enterica_serovar_Typhimruium_UK_1_uid87049 | CAS-I-E:0.0,):0.00521)0.912:0.00521)0.738:0.00647
):0.415:0.00584,(((157155405 | Escherichia_coli_E24377A_uid58395 | CAS-I-E:0.00516,(
291284082 | Escherichia_coli_O55_H7_CB9615_uid46655 | CAS-I-E:0.0,
387508107 | Escherichia_coli_O55_H7_RM12579_uid162153 | CAS-I-E:0.0,
209397933 | Escherichia_coli_O157_H7_EC4115_uid59091 | CAS-I-E:0.0,
15803272 | Escherichia_coli_O157_H7_EDL933_uid57831 | CAS-I-E:0.0,
15832863 | Escherichia_coli_O157_H7_Sakai_uid57781 | CAS-I-E:0.0,
254794695 | Escherichia_coli_O157_H7_TW14359_uid59235 | CAS-I-E:0.0,
```

FIG. 10T-1

```
387883934 | Escherichia_coli_Xuzhou21_uid163995 | CAS-I-E:0.0): 0.00517)0.000:0.00014,(((
170681830 | Escherichia_coli_SMS_3_5_uid58919 | CAS-I-E:0.00519,(209920201 | Escherichia_coli_SE11_uid59425 | CAS-I-E:0.01037,
218555302 | Escherichia_coli_IAI1_uid59377 | CAS-I-E:0.00014 )0.000:0.00015 )0.862:0.00520,(
387608391 | Escherichia_coli_042_uid161985 | CAS-I-E:0.0,218696353 | Escherichia_coli_55989_uid59383 | CAS-I-E:0.0,
386700332 | Escherichia_coli_KO11FL_uid162099 | CAS-I-E:0.0,378711820 | Escherichia_coli_KO11FL_uid52593 | CAS-I-E:0.0,
544391272 | Escherichia_coli_LY180_uid219461 | CAS-I-E:0.0,
410481280 | Escherichia_coli_O104_H4_2009EL_2050_uid175905 | CAS-I-E:0.0,
407470625 | Escherichia_coli_O104_H4_2009EL_2071_uid176128 | CAS-I-E:0.0,
407480714 | Escherichia_coli_O104_H4_2011C_3493_uid176127 | CAS-I-E:0.0, 386610119 | Escherichia_coli_W_uid162011 | CAS-I-E:0.0,
386710611 | Escherichia_coli_W_uid162101 | CAS-I-E:0.0, 443618784 |Escherichia_coli_APEC_O78_uid187277 | CAS-I-E:0.0):0.00014
)0.744:0.00014)0.000: 0.00015, (82545172 |Shigella_boydii_Sb227_uid58215 | CAS-I-E:0.00516,(
260845402 | Escherichia_coli_O103_H2_12009_uid41013 | part_CAS-I-E:0.0,
260869434 | Escherichia_coli_O111_H__11128_uid41023 | CAS-I-E:0.0,
260856866 | Escherichia_coli_O26_H11_11368_uid41021 | CAS-I-E:0.0):0.00518 )0.000:0.00014 )0.956:0.02981 )0.872:0.01092
)0.485:0.00563,397659651 | Klebsiella_oxytoca_E718_uid170256 | CAS-I-E:0.02749) 0.872:0.01919 )0.881:0.02441 )0.950:0.03300,(((
(((16761710 | Salmonella_enterica_serovar_Typhi_CT18_uid57793 | CAS-I-E:0.0,
378961003 | Salmonella_enterica_serovar_Typhi_P_stx_12_uid87001 | CAS-I-E:0.0,
488655309 | Salmonella_enterica_serovar_Typhi_Ty21a_uid201427 | CAS-I-E:0.0,
29143194 | Salmonella_enterica_serovar_Typhi_Ty2_uid57973 | CAS-I-E:0.0):0.01045,((((
194444085 | Salmonella_enterica_serovar_Newport_SL254_uid58831 | CAS-I-E:0.0,
528820748 | Salmonella_enterica_serovar_Newport_USMARC_S3124_1_uid213895 | CAS-I-E:0.0):0.00513,
194734989 | Salmonella_enterica_serovar_Schwarzengrund_CVM19633_uid58915 | CAS-I-E:0.00519)0.000:0.00014,
538363509 | Salmonella_enterica_serovar_Bovismorbificans_3114_uid218006 | part_CAS-I-E:0.00014)0.000:0.00014,(
```

FIG. 10T-2

```
197363813 |Salmonella_enterica_serovar_Paratyphi_A_AKU_12601_uid59269| part_CAS-I-E:0.0,
56414885 |Salmonella_enterica_serovar_Paratyphi_A_ATCC_9150_uid58201| part_CAS-I-E:0.0) :0.00512) 0.000:0.00016
)0.953: 0.03045,288933828 |Klebsiella_variicola_At_22_uid42113 |CAS-I-E:0.04931) 0.720:0.01572,((
238901892 |Escherichia_coli_BW2952_uid59391 |CAS-I-E:0.0,386594505 |Escherichia_coli_DH1_uid161951 |CAS-I-E:0.0,
387622438 |Escherichia_coli_DH1_uid162051 | CAS-I-E:0.0,170082330 |Escherichia_coli_K_12_substr__DH10B_uid58979 |CAS-I-E:0.0,
471334375 |Escherichia_coli_K_12_substr__MDS42_uid193705 |CAS-I-E:0.0,
16130662 |Escherichia_coli_K_12_substr__MG1655_uid57779 |CAS-I-E:0.0,
388478772 |Escherichia_coli_K_12_substr__W3110_uid161931 |CAS-I-E:0.0) :0.00520,(
170018999 |Escherichia_coli_ATCC_8739_uid58783 |CAS-I-E:0.0,387613378 |Escherichia_coli_ETEC_H10407_uid161993 |CAS-I-E:0.0,
386615473 |Escherichia_coli_UMNK88_uid161991 |CAS-I-E:0.0,
218547725 |Escherichia_fergusonii_ATCC_35469_uid59375| CAS-I-E:0.0,157162204 |Escherichia_coli_HS_uid58393 |CAS-I-E:0.0,
):0.00016) 0.915:0.02436) 0.742:0.00786, 387890346 |Escherichia_blattae_DSM_4481_uid165043 |CAS-I-E:0.02625) 0.908:0.02156,((
470152912 |Pectobacterium_SCC3193_uid193707|CAS-I-E:0.0,403056816 |Pectobacterium_carotovorum_PCC21_uid174335 |CAS-I-E:0.0,
261819747 |Pectobacterium_wasabiae_WPP163_uid41297 |CAS-I-E:0.0):0.02893,((
271498931 |Dickeya_dadantii_Ech586_uid42519|CAS-I-E:0.00015,242240984 |Dickeya_dadantii_Ech703_uid59363 |CAS-I-E:0.02086
)0.999:0.07181, 541862392 |Serratia_ATCC_39006_uid218470 |CAS-I-E:0.01031) 0.914: 0.02527)0.940:0.03004) 0.931 :0.02510
)0.756:0.03101, (((292898489 |Erwinia_amylovora_ATCC_49946_uid46943 |CAS-I-E:0.0,
292489282 |Erwinia_amylovora_CFBP1430_uid46839|CAS-I-E:0.0) 0.04778, (385785743 |Erwinia_Ejp617_uid159955 |CAS-I-E:0.00537,(
387870239 |Erwinia_pyrifoliae_DSM_12163_uid159693 |CAS-I-E:0.0,259907486 |Erwinia_pyrifoliae_Ep1_96_uid40659 |CAS-I-E:0.0
):0.02139) 0.737:0.00654) 0.999:0.08785, (158522999 |Desulfococcus_oleovorans_Hxd3_uid58777|CAS-I-E:0.10332,(
92112367 |Chromohalobacter_salexigens_DSM_3043_uid62921|CAS-I-E:0.13534,((
47104059 |Photobacterium_profundum_SS9_uid62923|CAS-I-E:0.05728,((
290476726|Xenorhabdus_bovienii_SS_2004_uid46345|CAS-I-E:0.03658,
300724526|Xenorhabdus_nematophila_ATCC_19061_uid49133|CAS-I-E:0.04513)0.992: 0.06109,(
152997544 |Marinomonas_MWYL1_uid58715 |CAS-I-E:0.09401,119945309 |Psychromonas_ingrahamii_37_uid58521 |CAS-I-E:0.09011
)0.903:0.03170) 0.853:0.04021) 0.693:0.03373,332142270 |Alteromonas_macleodii__Deep_ecotype__uid58251 |CAS-I-E:0.10035
)0.787:0.02962) 0.833:0.02561) 0.993:0.07837)0.428:0.01425) 0.973:0.05920) 0.898:0.03430,(
304310409 |gamma_proteobacterium_HdN1_uid51635|CAS-I-E:0.06410,((
300703390|Ralstonia_solanacearum_CFBP2957_uid50545 |CAS-I-E:0.00015,
386332757 |Ralstonia_solanacearum_Po82_uid162133 |CAS-I-E:0.01028) 0.969:0.05341,(
146308770 |Pseudomonas_mendocina_ymp_uid58723|CAS-I-E:0.05798,
514412891 |Pseudomonas_aeruginosa_RP73_uid209328|CAS-I-E:0.05360) 0.761:0.03010)0.876:0.04269) 0.802:0.04322)0.919:0.05965
)0.882:0.04654) 0.955:0.05999) 0.209: 0.03422,(302036890 | Candidatus_Nitropsira_defluvii_uid51175 |CAS-I-E:0.10009,
347538517 |Pseudogulbenkiania_NH8B_uid3423 |CAS-I-E:0.13133) 0.896:0.03840) 0.762:0.03686) 0.868:0.04909) 0.755:0.10096
) 1.000:0.47262)0.880:0.12218) 0.973:0.14695) 0.889:0.11264,((
209966592|Rhodospirillum_centenum_SW_uid58805|CAS-I-E:0.26074,
384261406|Rhodospirillum_photometricum_uid159003|CAS-I-E:0.22994)0.987:0.29530,((
83591687|Rhodospirillum_rubrum_ATCC_11170_uid57655|CAS-I-E:0.0,386348372 |Rhodospirillum_rubrum_F11_uid162149|CAS-I-E:0.0
):0.28481,(((114320110 |Alkalilimnicola_ehrlichii_MLHE_1_uid58467 |CAS-I-E:0.14090,
53804737 |Methylococcus_capsulatus_Bath_uid57607|CAS-I-E:0.14981)0.997:0.20789,(
268316057 |Rhodothermus_marinus_DSM_4252_uid41729 |CAS-I-E:0.33168,(197121198 |Anaeromyxobacter_K_uid58953 |CAS-I-E:0.01546,
220915900 |Anaeromyxobacter_dehalogenans_2CP_1_uid58989|CAS-I-E:0.02206)1.000:0.28183)0.945:0.12305) 0.931:0.08221,((
328544463|Polymorphum_gilvum_SL003B_26A1_uid65447|CAS-I-E:0.20106,(
159045760 |Dinoroseobacter_shibae_DFL_12_uid58707|CAS-I-E:0.21055,
```

FIG. 10U-1

114328362|Granulibacter_bethesdensis_CGDNIH1_uid58661|CAS-I-E:0.20529}0.941:0.10554}0.948:0.08183,(
377813512|Burkholderia_YI23_uid81081 |CAS-I-E:0.07724,(217970636 |Thauera_MZ1T_uid58987 |CAS-I-E:0.10567,(
257093834|Candidatus_Accumulibacter_phosphatis_clade_IIA_UW_1_uid59207|CAS-I-E:0.07785,
390949470|Thiocystis_violascens_DSM_198_uid74025| CAS-I-E:0.11213}0.591:0.02668} 0.917:0.05762} 0.998:0.16644} 0.368:0.05166
}0.111:0.07696} 0.751:0.14944} 1.000:0.79888} 0.095:0.19147} 0.979:0.42150} 0.956:0.37661} 0.982:0.64716} 0.803:0.44513
}0.279:0.14905} 0.790:0.13738} 0.286:0.06358} 0.781:0.04481,((((
332668016| Haliscomenobacter_hydrossis_DSM_1100_uid66777|part_unk_CAS-II-C_CAS-III-A_:1.02573,(
327314603| Prevotella_denticola_F0289_uid65091|CAS-III-D:0.78741,(
392395717| Flexibacter_litoralis_DSM_6794_uid168257|part_unk_CAS-II-C_CAS-III-A_:0.63783,
379728404| Saprospira_grandis_Lewin_uid89375|part_unk_CAS-II-C_CAS-V-A_:0.79485}0.591:0.11035}0.838:0.12407
}0.294:0.16097,((((224367660 | Desulfobacterium_autotrophicum_HRM2_uid59061|CAS-I-B:0.20306,(
328951839 |Desulfobacca_acetoxidans_DSM_11109_uid65785|CAS-I-B:0.25288,
408420400 |Desulfobacula_toluolica_Tol2_uid175777|CAS-I-B:0.22329}0.820:0.07168} 1.000:0.35019,(
257125862 |Leptotrichia_buccalis_C_1013_b_uid59211|part_CAS-III:0.55068,
218961577 |Candidatus_Cloacamonas_acidaminovorans_Evry_uid62959|CAS-I-B:0.48447}0.655:0.10549}0.947:0.11304,((
312143828| Halanaerobium_hydrogeniformans_uid60191|CAS-I-B:0.17251,
220932357| Halothermothrix_orenii_H_168_uid58585|CAS-III-B_CAS-I-B:0.12708} 1.000:0.31146,(((
374296492| Clostridium_clariflavum_DSM_19732_uid82345|CAS-III-D_CAS-I-B:0.09968,
125975696| Clostridium_thermocellum_ATCC_27405_uid57917|CAS-III-D:0.03618}1.000:0.28608,(
297619051 |Methanococcus_voltae_A3_uid49529|CAS-I-B_CAS-III-B:0.38612,((
150398983 |Methanococcus_vannielii_SB_uid58767|CAS-I-B:0.44520,(
134045811 |Methanococcus_maripaludis_C5_uid58741|CAS-I-B:0.01909,
340624264 |Methanococcus_maripaludis_X1_uid70729|CAS-I-B:0.00412}0.268:0.03527} 0.999:0.24577,
150398872 |Methanococcus_vannielii_SB_uid58767|CAS-III-B:0.64887}0.361:0.05772} 0.923:0.11081} 0.997:0.21011,(((

FIG. 10U-2

```
296109866| Methanocaldococcus_infernus_ME_uid48803 | CAS-I-B:0.17855,
150401497| Methanococcus_aeolicus_Nankai_3_uid58823|CAS-I-B_CAS-III-A:0.32938)1.000 :0.64269,(
330508932| Methanosaeta_concilii_GP6_uid66207 |CAS-I-B:0.33455,(
435851317| Methanomethylovorans_hollandica_DSM_15978_uid184864 |CAS-III-C:0.20820,(
432331519| Methanoregula_formicicum_SMSP_uid184406 |CAS-I-B:0.23240,(
21226661 |Methanosarcina_mazei_Go1_uid57893 |CAS-I-B:0.00015,
452209156 |Methanosarcina_mazei_Tuc01_uid190185 |part_CAS-I-B: 0.00857)1.000 :0.15221)0.892 :0.04117)0 .899:0.06793
)0.713: 0.06262)0.608 :0.04755,390952676 | Thiocystis_violascens_DSM_198_uid74025 |CAS-III-B:0.50453 )0.818:0.09676
)0.291: 0.03656)0.543 :0.05252)0.678 :0.07996, (284040851 |Spirosoma_linguale_DSM_74_uid43413|CAS-I-B: 0.37496,
295133386 |Zunongwangia_profunda_SM_A87_uid48073|CAS-I-B:0.39344)0.994 :0.25049 )0.546:0.09858 )0.961: 0.27858,(
332661941 |Haliscomenobacter_hydrossis_DSM_1100_uid66777| CAS-III-B: 0.53217,((870167543 | Marine_metagenome|CAS-V-C: 0.27908,
((100022928 | Marine_metagenome|CAS-V-C:0. 00016,859280137 | Marine_metagenome|CAS-V-C:0. 00014)1.000:0.23055, ((
100021578 |Marine_metagenome |CAS-V-C:0.0 ,100021580| Marine_metagenome| CAS-V-C:0.0}: 0.00014,(
843463465 |Marine_metagenome |CAS-V-C:0.0, 789198574| Marine_metagenome| CAS-V-C:0.0):0 .00014)0.994 :0.14907)0. 733:0.10747
)0.718:0 .12912,(( 100020997| Gut_metagenome|CAS-V-C:0.44423, ((866846155 | Marine_metagenome|CAS-V-C:0.0,
863357813 |Marine_metagenome |CAS-V-C:0.0, 869978290 |Marine_metagenome |CAS-V-C:0.0): 0.00453,
854156728 |Marine_metagenome |CAS-V-C:0.00053) 1.000:0.39566 )0.699:0.13902 ,((840849085 | Marine_metagenome|CAS-V-C:0. 00014,
843301408 |Marine_metagenome |CAS-V-C:0.00015) 0.999:0.34026 ,842971906 |Marine_metagenome |CAS-V-C:0.68807) 0.064:0. 06601
)0.929: 0.26110)1.000 :1.70447)0.995 :1.02522) 0.949:0.26368, (((((374326393 | Pyrobaculum_1860_uid823709|part_CAS-I-A:0.04.41,(
(18311699 |Pyrobaculum_aerophilum_IM2_uid57727 |part_CAS-I-A:0. 09509,
379004063| Pyrobaculum_oguniense_TE7_uid84411|part_unk_CAS-III-A_CAS-III-B_: 0.07930)0.995:0. 13198,
171185-47 | Pyrobaculum_neutrophilum_V24Sta_uid58421| part_CAS-I-A:0.13654)0.699: 0.06244)0.999 :0.51415, ((
145591351 |Pyrobaculum_arsenaticum_DSM_13514_uid58409 |CAS-III-B_CAS-I-A:0. 00828,
379004113 |Pyrobaculum_oguniense_TE7_uid84411|CAS-I-A_CAS-III-B:0. 01001)0.498:0. 06626,((
374326449 |Pyrobaculum_1860_uid82379|CAS-I-A :0.14299,18311772 | Pyrobaculum_aerophilum_IM2_uid57727 | CAS-I-A :0.09584
)0.910: 0.03379,(126459887 |Pyrobaculum_calidifontis_JCM_11548_uid58787 |CAS-I-A_CAS-III-B:0.16292,
171185597 |Pyrobaculum_neutrophilum_V24Sta_uid58421|CAS-I-A_CAS-III-A: 0.17923)0.474: 0.02977)0.509: 0.06717)1.000 :0.66565
)0.959: 0.28079,(((( 549455431| Aeropyrum_camini_SY1___JCM_12091_uid222311| CAS-I-A:0.00883,
118431380 |Aeropyrum_pernix_K1_uid57757| CAS-I-A:0.02086) 1.000:0.61532,(
305663330 |Ignisphaera_aggregans_DSM_17230_uid51875|part_CAS-I-A:0.20876,(
307595807 |Vulcanisaeta_distributa_DSM_14429_uid52827 |part_CAS-I-A: 0.09159,
325968915 |Vulcanisaeta_mouthovskia_768_28_uid63631 |CAS-I-A:0.12735 )1.000:0.53214 )0.261:0. 09614)0.037: 0.12515,(
124027534 |Hyperthermus_butylicus_DSM_5456_uid57755| CAS-I-A: 0.60062,
156937921 |Ignicoccus_hospitalis_KIN4_I_uid58365|CAS-I-A: 0.76251)0.968: 0.22342)0.931: 0.14505, (((
296242547 |Thermosphaera_aggregans_DSM_11486_uid48993 | CAS-I-A:0.43927,(
389861365 |Thermogladius_1633_uid167488|part_CAS-I:0.48619,(
390938732 |Desulfurococcus_fermentans_DSM_16532_uid75119|CAS-I-A: 0.01825,
218884093 |Desulfurococcus_kamchatkensis_1221n_uid59133|CAS-I-A_CAS-III-B:0.03676)1.000: 0.36831)0.323 :0.07634
)0.994 :0.20404,(530780292 |Thermofilum_1910b_uid215374 |CAS-I-A:0.54406,(
15922975 |Sulfolobus_tokodaii_7_uid57807|CAS-I-A:0.31907, (
146303916 |Metallosphaera_sedula_DSM_5348_uid58717 |CAS-I-A_CAS-III-D:0.26004,((
332797424 |Acidianus_hospitalis_W1_uid66875|CAS-I-A:0. 03072,((
227829656 |Sulfolobus_islandicus_L_S_2_15_uid58871|CAS-III-D_CAS-I-A:0.00900,(
284997246 |Sulfolobus_islandicus_L_D_8_5_uid43679|CAS-I-A:0.0,
229578570 |Sulfolobus_islandicus_Y_G_57_14_uid58923|CAS-III-B_CAS-I-A:0.0,
```

FIG. 10V-1

229582665 |Sulfolobus_islandicus_Y_N_15_51_uid58825|CAS-I-A:0.0):0. 00015)0.910: 0.01557,(
385775488 |Sulfolobus_islandicus_REY15A_uid162071|CAS-I-A:0.00015,(
479324820 |Sulfolobus_islandicus_LAL14_1_uid97216 |CAS-I-A :0.00456,
385772426 |Sulfolobus_islandicus_HVE10_4_uid162067|CAS-I-A:0.00014) 0.862:0.00895 )0.888:0.02072) 0.851:0.01716
)0.976: 0.11214,((227827211 |Sulfolobus_islandicus_M_14_25_uid58849| CAS-I-A:0.0,
229584430| Sulfolobus_islandicus_M_16_27_uid58851|CAS-I-A:0.0,
238619345| Sulfolobus_islandicus_M_16_4_uid58841|part_CAS-I-A:0.0) :0.01443,
15898286| Sulfolobus_solfataricus_P2_uid57721|CAS-III-D_CAS-I-A:0.06865) 1.000:0.16400) 0.973:0.13473)0.999: 0.36997
)1.000:0. 27476)0.863: 0.08395)0.455: 0.08894,((347523053 |Pyrolobus_fumarii_1A_uid73415|CAS-I-A: 0.61090,
385805115| Fervidicoccus_fontis_Kam940_uid162201|CAS-I-A_CAS-III-B:1.11807)0. 303:0.09916,(
302347808| Acidilobus_saccharovorans_345_15_uid51395|CAS-III-B: 0.54552,
549454990| Aeropyrum_camini_SY1___JCM_12091_uid223311|CAS-I-A:0.48230 )0.976:0.26168 )0.903:0.12515)0.832: 0.11318
)0.944:0. 12876)0.997 :0.30745,(408403000 |Candidatus_Nitrososphaera_gargensis_Ga9_2_uid176707|CAS-I-B:0.93153, ((((
34541577 |Porphyromonas_gingivalis_W83_uid57641|CAS-III-B:0.00090,
334146064| Porphyromonas_gingivalis_TDC60_uid67407|CAS-III-B:0.01081)1.000:0.95462,(
54296139 |Legionella_pneumophila_Paris_uid58211|CAS-II-B:0.60415,(
118497353 |Francisella_novicida_U112_uid58499|CAS-III-B:0.42629,
34557933| Wolinella_succinogenes_DSM_1740_uid61591| CAS-III-B:0.41083)0.772:0.13964)0.995:0. 39164)0.119: 0.18705,(
328954440| Desulfobacca_acetoxidans_DSM_11109_uid65785|CAS-III-D:0.67570,
386750121 |Helicobacter_cetorum_MIT_00_7128_uid162217 |part_unk_CAS-II-C_CAS-V-A_:0.94177)0.939: 0.19730)0.455:0. 09688,(
386854797| Deinococcus_gobiensis_I_0_uid162509| CAS-I-A:0.73175,(((
320162242 |Anaerolinea_thermophila_UNI_1_uid62245|CAS-I-B_CAS-III-B:0. 24646,
386346444 |Spirochaeta_thermophila_DSM_6578_uid162041|CAS-I-D:0. 30635)0.973:0. 10913,(

FIG. 10V-2

```
383762541|Caldilinea_aerophila_DSM_14534__NBRC_104270_uid158165|CAS-I-B:0.40105,(
159901591|Herpetosiphon_aurantiacus_DSM_785_uid58599|CAS-I-B:0.34555,(((
222526429|Chloroflexus_Y_400_fl_uid59085|CAS-I-B:0.0,163848485|Chloroflexus_aurantiacus_J_10_fl_uid57657|CAS-I-B:0.0
):0.04214,219847509|Chloroflexus_aggregans_DSM_9485_uid58621|CAS-I-B:0.03495)1.0000:0.21386,(
148656004|Roseiflexus_RS_1_uid585223|CAS-III-D_CAS-I-B:0.05599,
156743243|Roseiflexus_castenholzii_DSM_13941_uid58287|CAS-III-D_CAS-I-B:0.07541)1.000:0.23232)0.915:0.09202
)0.232:0.05476)0.838:0.05590)0.998:0.19103,(4335853686|Halobacteroides_halobius_DSM_5150_uid184862|CAS-I-A:0.51629,(((
169831450|Candidatus_Desulforudis_audaxviator_MP104C_uid59067|CAS-I-B:0.31661,(
333980328|Desulfotomaculum_kuznetsovii_DSM_6115_uid67357|CAS-I-A:0.24229,(
260893609|Ammonifex_degensii_KC4_uid41053|CAS-I-D:0.14763,
410668222|Thermacetogenium_phaeum_DSM_12270_uid177811|CAS-I-D:0.14104)0.935:0.08867)0.937:0.08635)0.971:0.11431,(
333922948|Desulfotomaculum_carboxydivorans_CO_1_SRB_uid67317|CAS-I-B:0.34167,
167628642|Heliobacterium_modesticaldum_Ice1_uid58279|CAS-I-A:0.42465)0.876:0.09928)0.925:0.09067)0.410:0.08603
)0.719:0.05750)0.527:0.04585)0.772:0.04166)0.925:0.13227)0.740:0.08719,(((
11499462|Archaeoglobus_fulgidus_DSM_4304_uid57717|CAS-III-B_CAS-I-A:0.38556,
383319612|Methanocella_conradii_HZ254_uid157911|CAS-I-B:0.49250)0.880:0.10603,(
288560430|Methanobrevibacter_ruminantium_M1_uid45857|CAS-III-A:0.35838,(
509155171|Methanobrevibacter_AbM4_uid206516|part_unk_CAS-II-C_CAS-III-A_:0.32331,
148642083|Methanobrevibacter_smithii_ATCC_35061_uid58827|part_unk_CAS-II-C_CAS-III-A_:0.35778)1.000:0.35350
)0.999:0.34850)0.991:0.21189,(330509017|Methanosaeta_concilii_GP6_uid66207|part_CAS-I-A:0.58550,(((
170290046|Candidatus_Korarchaeum_cryptofilum_OPF8_uid58601|CAS-I-A_CAS-III-B:0.27503,
288932203|Ferroglobus_placidus_DSM_10642_uid40863|CAS-III-C_CAS-I-A:0.25855)0.964:0.21496,(
320101181|Desulfurococcus_mucosus_DSM_2162_uid62227|CAS-I-A:0.41037,
126465226|Staphylothermus_marinus_F1_uid58719|CAS-III-A_CAS-I-A:0.29857)0.917:0.19802)1.000:0.65030,(
557694426|Candidatus_Caldiarchaeum_subterraneum_uid227223|CAS-III-D:0.71862,(
15920199|Sulfolobus_tokodaii_7_uid57807|CAS-I-A:0.21009,(((
70607733|Sulfolobus_acidocaldarius_DSM_639_uid58379|part_unk_CAS-III-A_CAS-III-B_:0.0,
449068017|Sulfolobus_acidocaldarius_N8_uid189027|part_CAS-III:0.0,
449070290|Sulfolobus_acidocaldarius_Ron12_I_uid189028|part_CAS-III-:0.0):0.19890,
568164573|Sulfolobus_acidocaldarius_SUSAZ_uid232254|CAS-I-A_CAS-III-D:0.13987)0.996:0.14396,(
330834963|Metallosphaera_cuprina_Ar_4_uid66329|part_CAS-I:0.21905,(
332796067|Acidianus_hospitalis_W1_uid66875|part_CAS-III:0.27170,((
227827183|Sulfolobus_islandicus_MK_14_25_uid58849|CAS-I-A_CAS-II-D:0.0,
229584404|Sulfolobus_islandicus_M_16_27_uid58851|CAS-I-A_CAS-III-D:0.0)0.02892,(
384434706|Sulfolobus_solfataricus_98_2_uid167998|CAS-I-A:0.0,15898245|Sulfolobus_solfataricus_P2_uid57721|CAS-I-A:0.0
):0.01264)0.980:0.09652)0.984:0.10357)0.311:0.03650)0.719:0.06509)0.999:0.55900)0.996:0.44626)0.379:0.14245
)0.920:0.16437)0.510:0.08365)0.887:0.08451)0.922:0.17107)1.000:0.21115)0.350:0.08970,(
88602029|Methanospirillum_hungatei_JF_1_uid58181|CAS-III-D:1.16860,(
326793969|Marinomonas_mediterranea_MMB_1_uid64753|CAS-III-B:0.81220,
220934970|Thioalkalivibrio_sulfidophilus_HL_EbGr7_uid59179|CAS-III-B:0.75197)0.988:0.33497)0.798:0.14503)0.771:0.03996
)0.801:0.05244)0.715:0.02153)0.300:0.03393);
```

FIG. 10W

| SEQ ID NOs: | | | | | | | | | | |
|---|---|---|---|---|---|---|---|---|---|---|
| | C2c1 | | | | | | | | | |
| 202,203,204,205 | 544884152 | Bacil Alicyclobacillus_a | 564 | LRVMSVDLGLRTSASISV | 57 | QRTLRQLRTQLAY-LRLLVRCGS | 181 | CQLILLFDLS-EY | 118 | HQIHADMAAQNLQQR | 987 |
| 206,207,208,209 | 652589596 | Bacil Alicyclobacillus_c | 314 | VRVMSVDLGVRYGAAISV | 50 | KQALAATRAEMSI-LRKWLRVSQ | 186 | CDLILLFDLS-RY | 114 | KCVHADMAAHNLQRR | 731 |
| 210,211,212,213 | 652932497 | delta Desulfovibrio_inop | 582 | LRVLSVDLGMRTFASCSV | 56 | RAEIYALKRDIQR-LKSLLRLGE | 179 | CQLILFFDLA-RY | 127 | CVIHADMAAQNLQRR | 1011 |
| 214,215,216,217 | 667765471 | delta Desulfonatronum_th | 610 | LRVLSVDLGVRSFACSV | 56 | MEELRSLNGDIRR-LKALLRLSV | 177 | CRLILFFDLA-RY | 126 | HVLHADMAAQNLQRR | 1036 |
| 218,219,220,221 | 654153037 | Bacil Tuberibacillus_cal | 574 | LRVMSVDLGRQAAAISI | 50 | DQAIRDLSRKIKF-LRKNVLNMQK | 163 | CQLVLFFDLS-RY | 122 | VITHADMAAQNLQKR | 976 |
| 222,223,224,225 | 754485389 | Bacil Bacillus_thermoamy | 568 | LRVMSIDLGRQAAAASI | 51 | EDNIKLMNQKLNF-LRNVLHFQQ | 163 | CQLILFFDLS-NY | 113 | VTTHADMAAQNLQKR | 962 |
| 226,227,228,229 | 651512544 | Bacil Bacillus_sp_NSP2 | 565 | FRVMSLDLLRAAAATSI | 51 | FQLHQRVKFQIRV-LAQIMRMAN | 169 | CQVILFFNLS-QY | 119 | VFLQADMAAHNLQKR | 971 |
| 230,231,232,233 | 506407588 | Alpha Methylobacterium_n | 98 | LRVLSVDLGVRSFACSV | 49 | DAELRQLRGGLNR-HRQLLRAAT | 164 | CHVILFFDLS-RY | 129 | SRIHADMAAQNLQRR | 507 |
| | Cpf1 | | | | | | | | | |
| 234,235,236,237 | 478482906 | Therm Candidatus_Methano | 842 | LKLIELDRGERNLIYVIM | 21 | RKALDVREYDNKE-ARRNWTKVE | 24 | NAIVVMEDLNHGF | 230 | LPQDSDAGAYNIALK | 1185 |
| 238,239,240,241 | 740127304 | Syner Synergistes_jonesi | 868 | VNLIELDRGERNLMYVSL | 21 | HAKLNQKEKERDT-ARKSWKTIG | 24 | NAVIVMEDLNIGF | 237 | LPTDADAGAYNIALK | 1218 |
| 242,243,244,245 | 737666241 | Clost Lachnospiraceae_ba | 826 | PYVIELDRGERNLLYIWW | 29 | HSLLDKKEKERFE-ARQNWTSIE | 24 | DAVIALEDLNSGF | 243 | LPKNAEAGAYNIARK | 1190 |
| 246,247,248,249 | 118497971 | Gamma Francisella_tulare | 911 | VHISLDRGERHLAYTL | 25 | HDKLAAIEKDRDS-ARKDWKKIN | 24 | NAIVVMEDLNFGF | 237 | MPQDADAGAYHIGLK | 1265 |
| 250,251,252,253 | 738437422 | Gamma Moraxella_caprae | 871 | VNVIGLDRGERHLLYLTV | 30 | HKILDKREIERLN-ARVGWGEIE | 24 | NAIVVLEDLNFGF | 238 | QPQNAEAGAYHIALK | 1231 |
| 254,255,256,257 | 511047224 | Clost Lachnospiraceae_ba | 836 | MHIIELDRGERNLIYLOM | 30 | HQLLKTREDENKS-ARQSWQTIH | 24 | NAIVVLEDLNFGF | 235 | MPLDAEAGAYNIARK | 1193 |
| 258,259,260,261 | 640557447 | Bacte Prevotella_albensi | 856 | THIIIELDRGERHLLYLSL | 29 | HNLLEKREKERTE-ARHSWSSIE | 24 | NAIVVLEDLNGGF | 237 | FPENAEAGAYNIARK | 1214 |
| 262,263,264,265 | 746633217 | delta Smithella_sp | 857 | INLIGLDRGERHLLYYAL | 25 | HNLLDKKEGDRAT-ARQENGVIE | 24 | NAIVVMEDLNFGF | 241 | MPKNAEAGAYNIALK | 1215 |
| 266,267,268,269 | 565859195 | Bacte Porphyromonas_cans | 872 | MHVIELDRGERNLIYICV | 21 | HDLLESRDKDRQQ-ERRNWQFIE | 24 | KAVVALEDLNMGF | 237 | LPKDAEAGAYNIALK | 1222 |
| | TnpB | | | | | | | | | |
| 270,271,272,273 | 15898041 | Sulfo Sulfolobus_solfata | 188 | GKVVALDVGVEKLLITSD | 16 | VKHIHRELSRKKFLSNNWFKAKV | 27 | YDVVVMEGIHAKQ | 71 | WIADRFVASLNILRG | 371 |
| 274,275,276,277 | 17233293 | Nosto Nostoc_sp | 184 | LKITGLAVELNHFLIDSE | 16 | LKRLQRRLSKIKKGSNNRVKARN | 27 | SDLVAYEDLQVRN | 68 | HIQDRRWAARNILEL | 364 |
| 278,279,280,281 | 408402709 | Thaum Nitrososphaera_gar | 195 | AKPVGLDVEIAKFCHHSD | 16 | LRRAHRRVSRRQIGSNNRKKAKR | 27 | YDLIFLFRLRVMN | 64 | AILDRPVGAINILKR | 371 |
| 282,283,284,285 | 410681958 | epsil Helicobacter_pylor | 179 | KKAVELAMERTLIVTSD | 16 | LTKAQRRLSKKVKDSNNRKKQAK | 27 | YBLIGVVTLNVKA | 69 | TTHHRPVASVNIRNY | 360 |
| 286,287,288,289 | 392395860 | Bacte Flexibacter_litora | 130 | NQAVGLLMGITFFCLBSN | 16 | LRIANRSLSRKKKFSNGWYKKKV | 27 | NSLVVVEDLKVKN | 69 | HETNAEFASKNILSE | 311 |
| 290,291,292,293 | 288551665 | Gamma Escherichia_coli | 157 | ASMVGLDVAKLALTLSD | 16 | LARLQRQLSRKVKFSNNWQKQKR | 27 | HAMIVIEDLKVSN | 84 | YTANARVGARNILAA | 353 |
| 294,295,296,297 | 691228642 | Clost Clostridium_botuli | 177 | NKKMGLIVGLKEFATTSD | 16 | LAKLQKDLSRKKKNSNNRKKARL | 27 | NQAIVLFNLKVSN | 71 | MIMDRLIASKNLLNL | 360 |

FIG. 12-1

| SEQ ID NOs | Cas9 | | | | | | | | | |
|---|---|---|---|---|---|---|---|---|---|---|
| 298,299,300,301 | 227824983 | Negat Acidaminococcus sp | 4 MYTL□□GTNSVGYAV□ | 26 AERRSFRTSRRRL-DRRQQRVKL | 695 PKRIFI□ARDGE | 208 L□□A□□LAIVTGNV | 1001 |
| 302,303,304,305 | 291520705 | Clost Coprococcus catus | 4 EYPL□□□GTGSLGWAV□ | 26 EERRWERTARRRL-DRRNWRIQV | 696 PKNVV□AREKQ | 203 L□□A□□YLNIVVGNA | 997 |
| 306,307,308,309 | 42525843 | Spiro Treponema denticol | 7 DYFL□□□GTGSVGWAV□ | 26 EVRRLHRGARRRL-ERRKRIKL | 711 PKKLFI□AKGAE | 211 P□□A□□AYLAIVVGNV | 1023 |
| 310,311,312,313 | 47458868 | Molli Mycoplasma mobile | 14 KWVL□□□LATASVGWCI□ | 32 ETRRKKRGQRRRN-RRLFTRKRD | 515 IEKIVW□VTRSSN | 256 G□□A□□PYFITIISQY | 885 |
| 314,315,316,317 | 55822627 | Bacil Streptococcus ther | 3 DLVL□□□GTGSVGVGI□ | 23 LVRRTNRQGRRLT-RRKKHRIVR | 443 FDNIVI□AREIN | 220 H□□A□□LIIAASSQL | 757 |
| 318,319,320,321 | 218563121 | delta Campylobacter jeju | 2 ARLL□□□ISSIGWA□S | 26 LPRRLARSARKRL-ARRKARLNH | 405 VHKINI□LAREVG | 219 L□□A□□AVIAYANNS | 720 |
| 322,323,324,325 | 182624245 | Clost Clostridium perfri | 6 NYAL□□□GTSVGWAV□ | 28 LPRRLARGRRRLL-RRKAYRVER | 421 PVRLNI□LARDIA | 209 K□□A□□AVVGVTTQG | 732 |
| 326,327,328,329 | 187736489 | Verru Akkermansia mucini | 4 SL□□□□□YASIGWAV□ | 27 FKRREYRRLRRNI-RSRRVRIER | 493 ISNVCV□YGKELT | 254 L□□A□□AOVLGLIPYI | 846 |
| 330,331,332,333 | 189440764 | Actin Bifidobacterium lo | 41 RYRL□□□VGLNSVGLAAV | 35 NMSGVARRTRRVR-RRKRERLHK | 433 PVSVNI□□VRSSF | 244 R□□A□□PSVIAMMNTA | 821 |
| 334,335,336,337 | 34557932 | delta Wolinella succinog | 3 VSPL□V□LGKNTGFFS□ | 22 VGRRSARHSKRNN-IRNKLVKRL | 609 KVPIIL□NAFEY | 229 SS□A□□AVMARVARYQ | 931 |
| 338,339,340,341 | 54296138 | Gamma legionella pneumop | 7 LSPL□□LGKFTGVCI□ | 30 AQRRATRHRVRNK-KRNQFVKRV | 584 LIPIYL□NRFEF | 232 PS□A□□AILIMSIGI- | 920 |
| 342,343,344,345 | 118497352 | Gamma Francisella novici | 5 ILPL□□□VKNTGVFS□ | 30 NNRTARRHQRRGI-DRKQLVKRL | 817 HIPITI□SNAFEF | 255 YS□L□□AMLARCIAAD | 1175 |
| 346,347,348,349 | 71910582 | Bacil Streptococcus pyog | 4 KYSL□□□GTNSVGWAV□ | 38 EATRLKRTARRRY-TRRKNRICY | 674 PDNIVI□ARENQ | 212 Y□□A□□PYLNAVVGTA | 996 |
| | | | EEEEEEE EEEEEE | HHHHHHHHHHHH-HHHHHHHHH | EEEEEE | HHHHHHHHHHHHHHHH | |

| SEQ ID NOs | Cas9_homologs | | | | | | | | | |
|---|---|---|---|---|---|---|---|---|---|---|
| 350,351,352,353 | 313123202 | Bacil Lactobacillus delb | 58 KVSL□V□□GQRHIGFAL□ | 21 YTRKIYRRSKRNRKTRYRQARFL | 35 NPDLHI□VGKFDM | 138 KG□□A□-IAISGIKP | 320 |
| 354,355,356,357 | 298675090 | Metha Methanohalobium ev | 52 PWVA□□S□SKHIGCAAV | 21 KDRADYRRNRRGRKTRYRKPRFD | 34 VKKWIVT□ASFDI | 131 KI□YA□-VAICCDEN | 306 |
| 358,359,360,361 | 169834784 | Clost Clostridium botuli | 55 PIIL□□□SGYLNIGFSA□ | 21 KEKAMVRRQRRSR-IRYRKPRFN | 32 ITNILI□YANFDT | 135 KV□M□-PCIAGSSN | 310 |
| 362,363,364,365 | 375009168 | Bacil Geobacillus thermo | 52 PVSL□V□□GTRHVGCSAT | 21 AIRRQFRRSRRNRKTRYREARFL | 32 VTSVI□YAAFDT | 135 KS□M□A-RCISGNPL | 308 |
| 366,367,368,369 | 260892456 | Clost Ammonifex degensii | 60 SL□□A□V□VGSRVVGIAL□ | 23 TLRREYRRGRRYRIVRHRPCRNR | 30 ISCV□ML□VSSGV | 115 KS□H□□A-LSLFLPGG | 296 |
| 370,371,372,373 | 91791204 | Betap Polaromonas sp-JS | 41 PLR□K□□P□SKTTGVAL□ | 36 TARRQMRRRRRSN-LRCRAPRFL | 33 VRAISS□LVRFDM | 144 KI□A□A-ACVGQVRF | 321 |
| 374,375,376,377 | 75812782 | Nosto Anabaena variabili | 54 DLR□K□□P□AKITGIAL□ | 24 ISRRQLRRTRRNRKTRYRKPRFL | 32 ITALST□LVKFDM | 144 KT□N□□A-ACVGQSTP | 322 |
| 378,379,380,381 | 17233293 | Nosto Nostoc sp | 54 PLR□LK□P□AKYTGIAL□ | 24 TSRRQLRRCRRSRKTRYRQPRFF | 32 ITAISQ□LVKFDT | 144 KS□□A□□A-CCVGASTP | 322 |
| | | | EEEEEE EEEEEE | HHHHHHHHHHH | EEEE | E E EEE | |

| | | | | | | |
|---|---|---|---|---|---|---|
| 382,383,384 | RuvC (PDB:4EP5) Thermus thermoph | 1 MVVAGIDPGITHLGLGVV | | 45 PEAVAV□EQFFYR | 64 PS□L□A□-LAIALTHA | 154 |

FIG. 12-2

| SEQ ID NO: | | |
|---|---|---|
| 544884152_Alicyclobacillus_acidoterrestris | 548 | ------------------------------MAVKSIKVKLRLDDMPE---IRAG-------LNKLHKVNAGVPYYTEWLSILRQEN---LYRRSPNGDGQECDKT |
| 652589596_Alicyclobacillus_contaminans | 549 | ----------------------------------------------------------------------------------------------------- |
| 652932497_Desulfovibrio_inopinatus | 550 | ------------------------------MPTNTNLKLVLGANPENATLRRA-------LPSIHRJVNQAKRIEELLLCRGEA---YRIVDNEGKEAEIP |
| 667765471_Desulfonatronum_thiodismutans | 551 | ------------------------------------MVLGKRDDTAELRRA-------LWTHEHVNLAFEVEVRVLLRCRGRS---WMHLDR-RGDPVHVP |
| 497199019_Opitutaceae_bacterium_TAV5 | 552 | MSLNRIYQGRVAAVEIGTALAKGNVEWMPAAGGDEVLWQHELFQAAINYLVALIALADKNNPV.GPLISQMDNPQSPYHV |
| 654153037_Tuberibacillus_calidus | 553 | ------------------------------MATKSFILKAKTKNNPQ---LRLS-------LNKTHELFNEGVAYVWDLLSLHRQKD---LVMHNDE-DPDHPVVLK |
| 754485389_Bacillus_thermoamylovorans | 554 | ------------------------------MATRSFILKIEP-NEE---VKKG-------LNKTHEVLNHGIAYVWMNLKLLRQEA---IVEHHEQ-DPANPKKVS |
| 495056180_Brevibacillus_sp-_CF112 | 555 | ------------------------------MAIRSIKLKTHCGPEAQNLRKG-------LWRTHRLLNEGVAYVWMNLLFRQES---TGERPKELQELICHI |
| 651512544_Bacillus_sp-_NSP2-1 | 556 | ---------------------------------------EEEEEEE------------HHHHHHHH-----------------HHHHHHHHHHHHHH |
| Secondary_structure_for_651512544_(Jpred) | | * |
| 654874074_Desulfatirhabdium_butyrativorans | 557 | ------------------------MPISNNPPVTQRAVTIRLR-GADPSDLSWREA-------LWITHEAVNKGAKVFGMLLITRGGLDHILADTKVGCKGKPDRDP |
| 652569729_Alicyclobacillus_herbarius | 558 | MLKQAVLGNGPLINWEKNVKRGKGMATRSIKVKLRLGKHPD---IRAG-------TWQLHKAANAGVPYYTEWLSIMRQKN---LYTRGP-KGEQOLYRS |
| 652589403_Alicyclobacillus_contaminans | 559 | ------------------------MSVRSIKFKLMIG-GPQYTRIRRG-------LYXTHEWFNEGVPYVQEMLLMRQGD---VVRYQDD-XPEIVLS |
| 411770298_Citrobacter_freundii_ATCC_8090 | 560 | |
| 696372964_Citrobacter_freundii | 561 | |
| 492410745_Brevibacillus_agri | 562 | ------------------------------MEKDERFQL-------------HQPVKPQIRVLAQIMRWANKQ- |
| 492410748_Brevibacillus_agri | 563 | ------------------------------MAIRSIKLKLKTHCGPEAQNLRKG-------LWRTHRLLNEGVAYVWMKNLLFRQES---TGERPKELQELICHI |
| 495062547_Brevibacillus_sp-_CF112 | 564 | ------------------------------MAIRSIKLKLKTHCGPEAQNLRKG-------LWRTHRLLNEGVAYVWMKNLLFRQES---TGERPKELQELICHI |
| 506407588_Methylobacterium_nodulans | 565 | ----------------------------------------------------MLRQD------------- |
| 219945206_Methylobacterium_nodulans_ORS_2060 | 566 | ------------------------------MPVRSLKLKIVPRHPSELEKAQA-------LWSTHRJVNEAVSFYEQKLLLLRGET---------YSTSDGSVP |
| 760066057_Methylobacterium_nodulans | 567 | ----------------------------------------------------------------------------------------------------- |
| CONSENSUS_0.8 | | *.........................................H..........L.............. |
| RuvC-like_motifs | | // |

FIG. 13D-1

|  | SEQ ID NO: | | |
|---|---|---|---|
| 54484152_Alicyclobacillus_acidoterrestris | 548 | AEECKAELLPRLRAR------ | ---QVKNGHRGPAGSDDELLQLARQL--- |
| 652589596_Alicyclobacillus_contaminans | 549 | ------ | ---NGFNTAELLRKV--- |
| 652932497_Desulfovibrio_inopinatus | 550 | RHAVQEEALAFAKAR------ | ---QRHNGCISTYEQEHLDVLRQL--- |
| 66776547I_Desulfonatronum_thiodismutans | 551 | ESQVAEDALAMAREA------ | ---QRRNGWP-VVGEDEELLAIRYL--- |
| 497199019_Opitutaceae_bacterium_TAV5 | 552 | WGSFRQGRQRTGLS------ | ---QVAPYTTPGNNAPTLDEVFRSLLAGNPIDRAT |
| 654153037_Tuberibacillus_calidus | 553 | KEEIQERLMNKVREI------ | ---QQKNGFNGEV-SKDEVLEHERAL--- |
| 754485399_Bacillus_thermoamylovorans | 554 | KAEIQAELWDFVLKM------ | ---QKCNSFTHEV-DKDVVNLLREL--- |
| 495056180_Brevibacillus_sp-_CF112 | 555 | ------ | --- |
| 651512544_Bacillus_sp-_NSP2-1 | 556 | REQQQRNQADKNTQA------ | ---LPL-------DKALEALRQL--- |
| Secondary_structure_for_651512544_(Jpred) | | HHHHHH------ | ---H-------HHHHHHHHH--- |
| 654874074_Desulfatirhabdium_butyrativorans | 557 | TPEERKARRILALSWLSVESKLGAPSSYIVASGGEPAKRNDWVSALEILQSRKVAKSEIDWKRDCSASLSAAIRDAVWNRSKV | |
| 652569729_Alicyclobacillus_herbarius | 558 | GEQCCRELLQRIRER------ | ---QRLNGRIDEPGIDEELLKVARQL--- |
| 652589403_Alicyclobacillus_contaminans | 559 | AEHCKRELLRRLRQV------ | ---QKENVGR-TSHDEELLQVMRAL--- |
| 411770298_Citrobacter_freundii_ATCC_8090 | 560 | ------ | --- |
| 696372964_Citrobacter_freundii | 561 | ------ | --- |
| 492410745_Brevibacillus_agri | 562 | ------ | --- |
| 492410748_Brevibacillus_agri | 563 | REQQQRNQADKNTQA------ | ---LPL-------DKALEALRQL--- |
| 495062547_Brevibacillus_sp-_CF112 | 564 | REQQQRNQADKNTQA------ | ---LPLDKALEALRQL--- |
| 506407588_Methylobacterium_nodulans | 565 | ------ | --- |
| 219945206_Methylobacterium_nodulans_ORS_2060 | 566 | QDEVRQLLEQAREA------ | ---QARNGG-SGGSDDEIVRLCRSL--- |
| 760065057_Methylobacterium_nodulans | 567 | ------ | ---M--- |
| CONSENSUS_0.8 | | ............ | ............ |
| RuvC-like_motifs | | | |

| | SEQ ID NO: | | |
|---|---|---|---|
| 544884152_Alicyclobacillus_acidoterrestris | 548 | YELLVPQ---AIGAK------GDAQIARKFLSPLADKDA------ | |
| 652589596_Alicyclobacillus_contaminans | 549 | EEMRKD---SVGFD------ | |
| 652932497_Desulfovibrio_inopinatus | 550 | YERLVPSVNENNE------AGDAQAANAWVSPIMSAESEGGLSVDKVLDPPVNKKLEEKAPGWERASQIWIQSD--- | |
| 667765471_Desulfonatronum_thiodismutans | 551 | YEQIVPS---CLLDDLGKPLKGDAQKIGTNYAGPLFDSD--TCRRDEGADVACCGPFHEVAGKVLGALPEWATPISKQEFDGKDASHLRFKAHGGDDAFP | |
| 497199019_Opitutaceae_bacterium_TAV5 | 552 | LDAALMQLLKACDGA------GATQQEGSYWFKCPDDSTANFAGDPAMIRREQRLLEQVLHDPATHDSPALGSFDTYSIAT--- | |
| 654153037_Tuberibacillus_calidus | 553 | YEELVPS---AVGKS------GEANQISNKYLYLPLIDPA--S | |
| 754488389_Bacillus_thermoamylovorans | 554 | YEELVPS---SVEKK------GEANQLSNKFLYPLVDPN--S | |
| 495056180_Brevibacillus_sp._CF112 | 555 | | |
| 651512544_Bacillus_sp._NSP2-1 | 556 | YELLVPS---SVGQS------GDAQIISRKFLSPIVDPN--S | |
| Secondary_structure_for_651512544_(Jpred) | | HHHHHHH---HH------HHHHHHH | |
| 654874074_Desulfatirhabdium_butyrativorans | 557 | FDEAVKSVGSSLIRFEAWDMLERFFGSRDAYLIPMKDPPDKSSEFEQDKAKDLVQKAGQWLSSRYGTSEGADFCRMSDIYGKIAAWADNASQGGSSTVD | |
| 652569729_Alicyclobacillus_herbarius | 558 | YEVLVPS---SIGKS------GDAQLASNFLSPLVDPN--- | |
| 652589403_Alicyclobacillus_contaminans | 559 | YELLVPS---AVGKK------GDAASLSRKFLSPLAWKD--S | |
| 411770298_Citrobacter_freundii_ATCC_8090 | 560 | | |
| 696372964_Citrobacter_freundii | 561 | | |
| 492410745_Brevibacillus_agri | 562 | | |
| 492410748_Brevibacillus_agri | 563 | YELLVPS---SVGQS------GDAQIISRKFLSPLVDPN--S | |
| 495062547_Brevibacillus_sp._CF112 | 564 | YELLVPS---SVGQS------GDAQIISRKFLSPLVDPNS--- | |
| 506407588_Methylobacterium_nodulans | 565 | | |
| 219945206_Methylobacterium_nodulans_ORS_2060 | 566 | YEAIVLA------DDANAQLANAFIGPLTDPNSAGFLEAPNKVDRPAPSWLDQVPASDFIDPAVLAERANAWLDTD--- | |
| 760065057_Methylobacterium_nodulans | 567 | YEAIVLA------DDANAQLANAFIGPLTDPNSAGFLEANKVDRPAPSWLDQVPASDFIDPAVLAERANAWLDTD--- | |
| CONSENSUS_0.8 | | | |
| RuvC-like_motifs | | | |

| SEQ ID NO. | | | |
|---|---|---|---|
| 548984152_Alicyclobacillus_acidoterrestris | 548 | -----VGGLGIGIAKAGNKPR----- | -----WVRMREAGEPGWERKEKATRKSADRTA-----DVLRALA----- | ---DFG |
| 652589596_Alicyclobacillus_contaminans | 549 | | -----TDNPFA | |
| 652932497_Desulfovibrio_inopinatus | 550 | -----EGQSLLNKGSPPR----- | -----WIRKLRSGQP-WQDFVSQKKQELIKGNAPLIKQLK- | ---EMG |
| 667765471_Desulfonatronum_thiodismutans | 551 | -----WKKEKDKGISSWAVYIQKQLQHGQDPRT-----EVRRKLWL | ---ELG |
| 497199019_Opitutaceae_bacterium_TAV5 | 552 | RVSIEKANAHYEDPANQDALKNKAINKDD----- | -----PDTRTPQJTGPKARARLEQAITTLWRVRLPESAADFDRLASSLKKIPDDSRLNLQGYVGSSAKGEVQARLFAILLFRHLERSSFT | |
| 654153037_Tuberibacillus_calidus | 553 | -----QSGKGTANSGRKPR----- | -----WKKLKEAGDPSWKDAYEKWKERQDDPKL-----KILAALQ----- | ---SFG |
| 754485389_Bacillus_thermoamylovorans | 554 | -----QSGKGTASSGRKPR----- | -----WYNLKIAGDPSWEHEKKHEDKKDPLA-----KILGKLA----- | ---EYG |
| 495056180_Brevibacillus_sp_CF112 | 555 | | | |
| 651512544_Bacillus_sp_NSP2-1 | 556 | -----EGGKGTSKAGAKPT----- | -----WQKKKANDPTWEQDYEKWKKRREDPTA-----SVITTLE | ---EYG |
| Secondary_structure_for_651512544_(Jpred) | | ---EEE--- | ---HHHHHH------HE--HHHHHHH | ---H--- |
| 654874074_Desulfatirhabdium_butyrativorans | 557 | DIVSELRQHFDTKESKATNGLDWNIIGLSS----- | -----YTGHPFNPVEELLRQNTSINKSHLDDLKKANTRAESCKS----- | ---KIG |
| 652569729_Alicyclobacillus_herbarius | 558 | -----SKGGQSQSNAGRKPA----- | -----WQKMREGNPGWVAAKERYEQRKAIDPTK-----KMIEMLD----- | ---GLG |
| 652589403_Alicyclobacillus_contaminans | 559 | -----KGLHGESKAGNKPR----- | -----WKRLQEQGLP-YEEEYNRNLREKSDPAK-----HIPAQLA----- | ---SMG |
| 411770298_Citrobacter_freundii_ATCC_8090 | 560 | | | |
| 696372964_Citrobacter_freundii | 561 | | | |
| 492410745_Brevibacillus_agri | 562 | | | ---YG |
| 492410748_Brevibacillus_agri | 563 | -----EGGKGTSKAGAKPT----- | -----WQKKKEANDPTWEQDYEKWKKRREDPTA-----SVITTLE | ---EYG |
| 495062547_Brevibacillus_sp_CF112 | 564 | -----EGGKGTSKAGAKPT----- | -----WQKKKEANDPTWEQDYEKWKKRREDPTA-----SVITTLE | ---EYG |
| 506407588_Methylobacterium_nodulans | 565 | | | |
| 219945206_Methylobacterium_nodulans_ORS_2060 | 566 | -----AGRAMLVDTGAPPR----- | -----WRSLAAKQDPIWPREFARKLGELRKEAASGTSAIIKALKR----- | ---DFG |
| 760065057_Methylobacterium_nodulans | 567 | -----AGRAMLVDTGAPPR----- | -----WRSLAAKQDPIWPREFARKLGELRKEAASGTSAIIKALKR----- | ---DFG |
| CONSENSUS_0.8 | | ........................... | ........................... | ....... |
| RuvC-like_motifs | | | | |

FIG. 13D-4

| SEQ ID NO. | | | |
|---|---|---|---|
| 544884152_Alicyclobacillus_acidoterrestris | 548 | ---LKPLMRVYIDSE---MSSVEWKPLRKGGAVRTWD--- | ---RDMFQQAIERMMSWE--- | ---SWNQRVGQEVAKLVEQKARFEQK |
| 652589596_Alicyclobacillus_contaminans | 549 | | | |
| 652932497_Desulfovibrio_inopinatus | 550 | ---LLPLVNPF--- | ---FRHLLDPEGKGVSPWD--- | ---RLAVRAAVAHFISWE--- | ---SWNHRTRAEVNSKIRDEFEAA |
| 667765471_Desulfonatronum_thiodismutans | 551 | ---LLPLFIPVFDK--- | ---TWGNLMN--- | ---RLAVRLALAHLLSWE--- | ---SWNHRAVDQQALARAKDELAAL |
| 491919019_Opitutaceae_bacterium_TAV5 | 552 | LGHLLRSATPPPRNAETPPPAGVPLPAASADPVRIARGK | | ---PSFTVRAFTSLPCWHGSDNIHPTWKSFDIAAFKVALTVNQIEEK |
| 654153037_Tuberibacillus_calidus | 553 | ---LIPLRPFTENDHKAVISVXMPKSNQSVRKFD--- | | ---KDMFNQAIERFLSWE--- | ---SWNEKVADYERKTVSIYESLQKE |
| 754485389_Bacillus_thermoamylovorans | 554 | ---LIPLFIPFDSNEP-TVKEIKWMEKSRNQSVRRLD--- | | ---KDMFTQALARRFISWE--- | ---SWNLIKFEEVRVEKEHRTLEER |
| 651512544_Brevibacillus_sp-CF112 | 555 | | | | ---MPK |
| Secondary_structure_for_651512544_(Jpred) | 556 | ---IRPIFPLYTNT---VTDIAWLPLQSNFQVRTWD--- | ---HH | ---RDMLQQAIERLLSWE--- | ---SWNKRVQEEVAKLKEKMAQLNEQ |
| 654874074_Desulfatirhabdium_butyrativorans | 557 | SKGQRPYSDALLNDVES-VCGFTVRVDKDGQPVSVADYSKYDVDYKWGTARHYTFAVMLDHAARRTSLAH | | ---KWIKRAEAERKPEDAKRIANV |
| 652569729_Alicyclobacillus_herbarius | 558 | ---IKPLFSVFIET---VTHGVKKDLSKRQGVRTWD--- | | ---RDMFQQAIEGLLSWE--- | ---SWNRRV--- |
| 652589403_Alicyclobacillus_contaminans | 559 | ---IKPIKVFTES---TEGTAWLPLARDQGVRTWD--- | | | |
| 411770298_Citrobacter_freundii_ATCC_8090 | 560 | | | | |
| 693672964_Citrobacter_freundii | 561 | | | | |
| 492410745_Brevibacillus_agri | 562 | | | | |
| 492410478_Brevibacillus_agri | 563 | ---IRPIFPLYTNT---VTDIAWLPLQSBQFVRTWD--- | | ---RDMLQQAIERLLSWE--- | ---SWNKRVQEEVAKLKEKMAQLNEQ |
| 495062547_Brevibacillus_sp-CF112 | 564 | ---IRPIFPLYTNT---VTDIAWLPLQSNQFVRTWD--- | | ---RDMLQQAIERLLSWE--- | ---SWNKRV--- |
| 506407588_Methylobacterium_nodulans | 565 | | | | |
| 219945206_Methylobacterium_nodulans_ORS_2060 | 566 | ---VLPLFQP--- | ---SLAPRILGSRSSLFPWD--- | ---RLAPRLAVGHLLSWE--- | ---SWCTRARDEHTARYQRILEQFSSA |
| 760065057_Methylobacterium_nodulans | 567 | ---VLPLFQP--- | ---SLAPRILGSRSSLFPWD--- | ---RLAPRLAVGHLLSWE--- | ---SWCTRARDEHTARYQRILEQFSSA |
| CONSENSUS_0.8 | | | | |
| RuvC-like_motifs | | | | |

FIG. 13E-1

| SEQ ID NO: | | |
|---|---|---|
| 548 | 54884152_Alicyclobacillus_caldoterrestris | NF--VGQEHIVHIVNQLQQPMKEASPGLESKEQTA------------------- ----------HYTGRALRGSDKVTEKWGKLAPDAP---- |
| 549 | 65258596_Alicyclobacillus_contaminans | ------------------------------------------------------ ----------HRTTRRAIRGWDRIAEAWRELPPDAP---- |
| 550 | 65292497_Desulfovibrio_inopinatus | S----DEEKDDFTLRQYEKRHSTLKSTALADDSNP-------------------- ----------YRIGVRSLRAWWRYREEWIDKGAT----- |
| 551 | 66765471_Desulfonatronum_thiodismutans | FL--GMEDGFAGLREVELRRNESIKQHAFPEVDRP-------------------- ----------IVVSGRALRSWTRVREEWLRHGDT----- |
| 552 | 49719901_Opitutaceae_bacterium_TAV5 | TKERQKECAELEDFDYMGRIAKFPVKYTTGEAFPPTIANDKRIPLLRELLQNIKVDTALITDGEAVSYGLQRRTIRGERELRRIWRGHAPAGTVFSSE |
| 553 | 654153037_Tuberibacillus_calidus | LK--GISTKAFLIMERVEKAYEAHLRE-TIFSNST-------------------- ----------YRLGNRAIRGWTEIVKKMWKLDPSAP---- |
| 554 | 75448589_Bacillus_termoamylovorans | IL--E-DIQAFKSLEQYEKERQEQLR-DILNTNE-------------------- ----------YRLSKRGLRGWREIIQKWLKMDENEP---- |
| 555 | 49056180_Brevibacillus_sp-_CF112 | IL--RGHK-WISLLEQYENRERLRENMTAANDK---------------------- ----------YRITKRQMKGWNELVELMSTFPASAS---- |
| 556 | 651512544_Bacillus_sp-_NSP2-1 | LE--GGQE-WISLLEQYENRERLRENMTAANDK---------------------- ----------YRITKRQMKGWNELVELMSTFPASAS---- |
| 557 | Secondary_structure_for_651512544_(Jpred) | ---HH-HHHHHHHHHHHHHHHHH--------H---------------------- ----------HHHHHEE--HHHHHHH------------- |
| 558 | 654874074_Desulfactirhabdium_butyrativorans | PARA-------REWLDSFCKRSVTSCAVEP------------------------- ----------YRIRRAVDGWKEVVAAWSKSDCKST---- |
| 559 | 652569729_Alicyclobacillus_herbarius | ------------------------------------------------------ --------------------------------------- |
| 560 | 652589403_Alicyclobacillus_contaminans | ------------------------------------------------------ ---------------MYELMSTFPASAS----------- |
| 561 | 411770298_Citrobacter_freundii_ATCC_8090 | ------------------------------------------------------ ---------------LYELMSTFPASAS----------- |
| 562 | 69572964_Citrobacter_freundii | ------------------------------------------------------ ----------------------DRWDF------------ |
| 563 | 492410745_Brevibacillus_agri | LE--GGQF-WISLLEQYENRERLRENMTAANDK---------------------- ----------YRITKRQMKGWNELVELMSTFPASAS---- |
| 564 | 492410478_Brevibacillus_agri | ------------------------------------------------------ --------------------------------------- |
| 565 | 49062547_Brevibacillus_sp-_CF112 | ------------------------------------------------------ --------------------------------------- |
| 566 | 50640758_Methylobacterium_nodulans | HLKGDLATKVSTLREYRARKEQTAQLGLPMGERD--------------------- ----------FLITVRMLRGWDDLREKWRSGDKG----- |
| 567 | 760065057_Methylobacterium_nodulans_ORS_2060 760065057_Methylobacterium_nodulans | HLKGDLATKVSTLREYRARKEQTAQLGLPMGERD--------------------- ----------FLITVRMLRGWDDLREKWRSGDKG----- |
| | CONSENSUS_0.8 | .........................R............................ ......................M................ |
| | RuvC-like_motifs | |

FIG. 13E-2

| | SEQ ID NO: | | | |
|---|---|---|---|---|
| 544484152_Alicyclobacillus_acidoterrestris | 548 | -FDLVDAFTKNVQRRNTRRFGSHDLF-AKLAEPEYQALW | -------RE------- | -DA-SFLTRYAVNSITRKINHAK-MFAITTLPDATAHP LWRFDK |
| 652589596_Alicyclobacillus_cotaminans | 549 | -ESEYIEAFKDIQRKNPRKIGSEPLF-KNLAAPGVRSEL | -------LN------- | -NP-QVLHTAXNELQRLAKAK-QFAQKTLPPVEHPVWVYDK |
| 652924497_Desulfovibrio_inopinatus | 550 | -EEQRVTLLSKLQTQLRGKFGDPDLF-NWLAQDRHVHLW | ----------------- | -SPRDSVTPLVRINAVDVLRRRK-PYALMTPAHPREHPWLLYEA |
| 667765471_Desulfonatronum_thiodismutans | 551 | -QESRKNICNRLQDRLRGKFGDPVF-HWLAEDGQEALW | -------KE------- | -R----DCVYSFSLNDADCLLEKRR-GYAMFADRLHPRWAMYEA |
| 497199019_Opitutaceae_bacterium_TAV5 | 552 | LKEKLAGELRQFTDNSTTIGSVQLFNELIQNPKVPIWQAPVHTARQWADAGAFAD-DPIAAIVQEAHIQCRDIDALK-APVKLPADPEYSRRQVDFNA | | |
| 654153037_Tuberibacillus_calidus | 553 | -QGNVLDVVKDYQRRHPRESGDFELF-ELLSRPENQAW | -------RE------- | -YP--EFTLPLVKYRHAEQRMKTAK-KQAIFTLCDPIRHPLWVRYEE |
| 754485389_Bacillus_thermoamylovorans | 554 | -SEKYILEVFKDYQRKHPREAGDYSVY-EFISKKENHSIW | -------RN------- | -HP--EYPYILAFFCEIDKKKDAK-CQAITTLADPINHPLWVRFEE |
| 495056180_Brevibacillus_sp_CF112 | 555 | -HEQYKEALKRVQQRLRGRFGDAHFF-QYIMEEKNRLIW | -------KG------- | -NP--QRIHYFVARNEITKRLEEAK-QSAIMTLPNARKHPLWVRFDA |
| 651512544_Bacillus_sp_NSP2-1 | 556 | -HEQYKEALKRVQQRLRGRFGDAHFF-QYIMEEKNRLIW | -------KG------- | -NP--QRIHYFVARNEITKRLEEAK-QSAIMTLPNARKHPLWVRFDA |
| Secondary_structure_for_651512544_(Jpred) | | ---HHHHHHHHH------HHHH-HHHHHHH-HHH | | ------EEEEEHHHHHHHHHHHHH-H------3------------EEEEEE |
| 654874074_Desulfatirhabdium_butyrativorans | 557 | -EDRTAAARALQDDSEIIKFKGDIQLF-EA-AEDDALCVW | -------HKDGEATNEP- | -DPQPLIDYSLATFARFKKRQFKVPAVRHPDELLHPVCDFGK |
| 652269729_Alicyclobacillus_herbarius | 558 | ----RDMFQSL------- | -------VG------- | -S--HTVHHDLDATASDAQIQYEL |
| 652289403_Alicyclobacillus_cotaminans | 559 | -REEYDALSARVYAYHAKHFAD------QPGWAVYW | -------PQ------- | -SQ-P |
| 411770298_Citrobacter_freundii_ATCC_8090 | 560 | -HEQYKEALKRVQQRLRGRFGDAHFF-QYIMEEKNRLIW | -------KG------- | -NP--QRIHYFVARNEITKRLEEAK-QSAIMTLPNARKHPLWVRFDA |
| 696372964_Citrobacter_freundii | 561 | -HEQYKEALKRVQQRLRGRFGDAHFF-QYIMEEKNRLIW | -------KG------- | -NP--QRIHYFVARNEITKRLEEAK-QSAIMTLPNARKHPLWVRFDA |
| 492410745_Brevibacillus_agri | 562 | -LDSIKQAVEQKKSPL----------DQTDRTFW | -------EG------- | -----TVCDLIKVLPRNF |
| 492410478_Brevibacillus_agri | 563 | -HEQYKEALKRVQQRLRGRFGDAHFF-QYIMEEKNRLIW | -------KG------- | -NP--QRIHYFVARNEITKRLEEAK-QSAIMTLPNARKHPLWVRFDA |
| 495062547_Brevibacillus_sp_CF112 | 564 | -QEEYAKLKEKMA----------QLNEQLECGQEM | ----------------- | -------CTLSR------- |
| 506407588_Methylobacterium_nodulans | 565 | -KQQKITYCINMMEVFEAKLGSADLL------LMW | -------DH------- | -----LGRIRDVDAGDIGSAFL-KLALDVAHVLPDGVDD |
| 219945206_Methylobacterium_nodulans_ORS_2060 | 566 | -QEALHAIIAHEQTRKRGRFGDPDLF-RWLARPEHNHVW | -------ADG------- | -HA--DAVGVLARVNAMERIVERSR-DTALMTLPDVAHPRSAQWEA |
| 760065057_Methylobacterium_nodulans | 567 | -QEALHAIIAFEQTRKRGRFGDPDLF-RWLARPEHNHVW | -------ADG------- | -HA--DAVGVLARVNAMERIVERSR-DTALMTLPDVAHPRSAQWEA |
| CONSENSUS_0.8 | | .................G.....F..L.......W | ................ | ..................................................H........ |
| RuvC-like_motifs | | | | |

```
                                           SEQ ID NO:
544484152_Alicyclobacillus_acidoterrestris  548 ------HFTGEFGGA-----KIQCRRDQLA------------HMHR--RCGARDVLNVSTRVQSQSE--ARGERPPYAAVFRLVG-----DNHRAFVHF
652589596_Alicyclobacillus_contaminans      549 ------LVPVAFGGA-----KLQFNRAHLS------------AGYRKGVLSAGGGSIYENVHLDVQYNE---------------------RDVSKTFSFSRD
652932497_Desulfovibrio_inopinatus          550 ------QFAGLAGGA-----EVLFHRPYME------------HDFRSTESLIRPGAWEKLTDVATQAP---------------------PNWLDGKGRVRT
667765471_Desulfonatronum_thiodismutans     551 ------QFEGLLGGA-----EILFDRKRIA------------NEQHGADBLASKPGHVMEKLTDVRPQAP--------------------QGHLDGKGRPAL
497199019_Opitutaceae_bacterium_TAV5        552 APLPTLPQDLTG-----MPVFLMPDVT------------LSGERRILNLPVTHEPAALVEQLGNAGRWQNQFFG-----------SREDFFALR
654153037_Tuberibacillus_calidus            553 ------ELKGTLGGA-----RIQFDRPHLL------------P-RQGVK-AGNVGRIFLNVILNIEPMQPFFRSGNLQTSVGKALKVVI--DGYPKVNEKPK
754495389_Bacillus_thermoamylovorans        554 ------PLKGTLGGA-----RVQFDRDHLR------------RYPHKVE-SGNVGRIVFNMTVNIEPT---------ESPVSKLKIHR--DDFPKFVNFKPK
495056180_Brevibacillus_sp-_CF112           555 ------TFNGHLGGA-----KLQLERGHLE------------KEKNFE--DGEIGSVILNVVLDFEPL-QEVMNGRVQAPYGQVLQLIRRPNEFPKVTTYKSE
651512544_Bacillus_sp-_NSP2-1               556 ------TFNGHLGGA-----KLQLERGHLE------------KEKNFE--DGEIGSVILNVVLDFEPL-QEVMNGRVQAPYGQVLQLIRRPNEFPKVTTYKSE
Secondary_structure_for_651512544_(Jpred)   ------EEEEE--E-----EEEE--HH------------HHHH----------EEEEEEEEEE-----HH-----------HHHHHHHHH---HHHH
654874074_Desulfatirhabdium_butyrativorans  557 NILGLFEQADWNGRLQAPRQQLEATAVVRDMPRLSQERNLRMCGMLEHPMLVITSVKLQPQ-------CPWCAYAEQ------HGLMTNPQY
652569729_Alicyclobacillus_herbarius        558 
652589403_Alicyclobacillus_contaminans      559 
411770298_Citrobacter_freundii_ATCC_8090    560 ------TFNGHLGGA-----KLQLERGHLE------------KEKTSR--TGKSAAFTLTL
696372964_Citrobacter_freundii              561 ------TFNGHLGGA-----KLQLERGHLE------------KEKTSR--TGKSAAFTLTL
492410745_Brevibacillus_agri                562 
492410748_Brevibacillus_agri                563 ------TFNGHLGGA-----KLQLERGHLE------------KEKNFE--DGEIGSVILNVVLDFEPL-QEVMNGRVQAPYGQVLQLIRRPNEFPKVTTYKSE
495062547_Brevibacillus_sp-_CF112           564 
506407588_Methylobacterium_nodulans         565 
219945206_Methylobacterium_nodulans_ORS_2060 566 ------LEAVGG--------ELQITLPLLK------------AADDGRC
760065057_Methylobacterium_nodulans         567 ------LEAVGG--------ELQITLPLLK------------AADDGRC
CONSENSUS_0.8                               
RuvC-like_motifs                            
```

FIG. 13F-1

| SEQ ID NO: | | |
|---|---|---|
| 544B4152_Alicyclobacillus_acidoterrestris | 548 | DKLSDYLAEHPDGKLGSEGLLSGLRVMSVDLGIRTSASISVRVARKDELK----------------------------------PNSKGRVPFFPIKGND |
| 652589596_Alicyclobacillus_contaminans | 549 | RDLIVSLKAELLKRTMETKPLGMPGTRVMSVDLGVYGAALSVEVKPPAEVR-----------------------------KDK------LHYPITGCE |
| 652932497_Desulfovibrio_inopinatus | 550 | PPEVHHFKTALSNKSKHRTRTLQPGLRVLSVDLGMRTFASCSVEIIEGKPETG----------------------------------RAEPVADER |
| 667765471_Desulfonatronum_thiodismutans | 551 | PPEAKHFKTALSNKSKFADQVRPGLRVLSVDLGVRSFAACSVELVRGGPDQ-----------------------------G-------TYPPAADGR |
| 497199019_Opitutaceae_bacterium_TAV5 | 552 | WPADGAVKTAKGKTHIPWHQRDHFTVLGVDLGTRDAGALALNVTAQKPAK-------------------------------------PVHRII |
| 654153037_Tuberibacillus_calidus | 553 | ELTEHIKESEKNTLNLGVSLPTGLRVMSVDLGIRVMSIDLGRQAAAISFEVVSEKPD-------------------------DNK------LFYPVKDID |
| 754485389_Bacillus_thermoamylovorans | 554 | ELITEWIKDSKGKKLKSGIESEIGLRVMSIDLGRQAAAASIEVVDQKRDI-------------------------------EGK------IFFPIKGTE |
| 49506180_Brevibacillus_sp-CF112 | 555 | QIVEMIKASPQHSA--GVSSLASGERVMSIDLGIRAAAATSIFSVEESSDKN---------------------------AAD------FSYWIEGTP |
| 651512544_Bacillus_sp-NSP2-1 | 556 | QIVEMIKASPQHSA--GVSSLASGFRVMSIDLGIRAAAATSIFSVEESSDKN---------------------------AAD------FSYWIEGTP |
| Secondary_structure_for_651512544_(Jpred) | | HHHHHHH-------------HHHHHHHHHEE--HHHH--EEEEE-------------------------------------EEEE |
| 648874074_Desulfatirhabdium_butyrativorans | 557 | NPHADINRDKVHARLILPPLP-GLRVLSVDIGHRYAACAVMEAVNTTVKEACQNVGRDMPKEHDLVLHIKVKKQGLCKQETVDKTTIVRIGADTLP |
| 652569729_Alicyclobacillus_herbarius | 558 | |
| 652589403_Alicyclobacillus_contaminans | 559 | |
| 411770298_Citrobacter_freundii_ATCC_8090 | 560 | QLVEMIKASPQHSA--GVSSLASGRVMSIDLGIRAAAATSIFI |
| 696372964_Citrobacter_freundii | 561 | |
| 492410745_Brevibacillus_agri | 562 | |
| 492410748_Brevibacillus_agri | 563 | QLVEMIKASPQHSA--GVSSLASGRVMSIDLGIRAAAATSIFL |
| 495062547_Brevibacillus_sp-CF112 | 564 | |
| 506407588_Methylobacterium_nodulans | 565 | -------------------GLRVLSIDIGVRSFATCSVEFLKDTAPTT-----------------------------G-------VAEPLAEFR |
| 219945206_Methylobacterium_nodulans_ORS_2060 | 566 | |
| 760065057_Methylobacterium_nodulans | 567 | |
| CONSENSUS_0.8 | | ......................V..VDLG.R............................................ |
| RuvC-like_motifs | | ......................D................................................. |

| | SEQ ID NO: | | |
|---|---|---|---|
| 544984152_Alicyclobacillus_acidoterrestris | 548 | DAANHWTPDWREAFENELQK | IKSLHGICSDKE----W |
| 652589596_Alicyclobacillus_contaminans | 549 | GGWTMDPGEDSDHQPIQQPI | HEARIAVGEIVMLVHLSPAEM |
| 652932497_Desulfovibrio_inopinatus | 550 | EEDVPGQA | PPRSIFQGLGAAPFRSTPEIW |
| 667765471_Desulfonatronum_thiodismutans | 551 | DDPIKSA | INAEILKGFGDRFRSTPDLW |
| 497199019_Opitutaceae_bacterium_TAV5 | 552 | RSWLRDLAFSDKALDEIHARRAGE | KPSPLPLAARDDAIKSTDEA |
| 654413037_Tuberibacillus_calidus | 553 | REEENP------VVVQEFFM | ISKVLY-SPHSV----W |
| 754485389_Bacillus_thermoamylovorans | 554 | NSDVPI------VVQDELIQ | IREIMY-KPYKD----W |
| 495056180_Brevibacillus_sp-_CF112 | 555 | QKKSPIDQTRTFWEGIVCD | LTKVLP-RNEAD----W |
| 651512544_Bacillus_sp-_NSP2-1 | 556 | QKKSPIDQTRTFWEGIVCD | LTKVLP-RNEAD----W |
| Secondary_structure_for_651512544_(Jpred) | 557 | | EEEE----------H |
| 654874074_Desulfatirhabdium_butyrativorans | | LGWTPAPDSSENISREDGEAKDYERSLAVDIMFSAVRTLRIALQRHGNRARIAYYLISEVKIRPGGIQKIDMGRIDLLQDALALWHFLPSSPGWRDE | |
| 652569729_Alicyclobacillus_herbarius | 558 | | |
| 652589403_Alicyclobacillus_contaminans | 559 | | |
| 411770298_Citrobacter_freundii_ATCC_8090 | 560 | SLISN | LCKK |
| 696372964_Citrobacter_freundii | 561 | SLISN | LCKK |
| 492410745_Brevibacillus_agri | 562 | | |
| 492410748_Brevibacillus_agri | 563 | | |
| 495062547_Brevibacillus_sp-_CF112 | 564 | | |
| 506407588_Methylobacterium_nodulans | 565 | EAWSAKE------LMFFEASL | LSELERCSTVADPL----W |
| 219945206_Methylobacterium_nodulans_ORS_2060 | 566 | | IDTPL |
| 760065057_Methylobacterium_nodulans | 567 | | IDTPL |
| CONSENSUS_0.8 | | | |
| RuvC-like_motifs | | | |

FIG. 13F-4

| SEQ ID NO: | | |
|---|---|---|
| 544884152_Alicyclobacillus_acidoterrestris | 548 | ----------------------------------------MDAVVESVRRVWRHMGKQVRDWRKDVRSGERPKIRGVAKDV--------------V |
| 652389596_Alicyclobacillus_contaminans | 549 | ----------------------------------------ERAVIERHRRLERITASHIRVEQTMRKVWGKRNEDAAH------------------T |
| 652332497_Desulfovibrio_inopinatus | 550 | ----------------------------------------RQHCQTYDKAEACLAKHISDWRKRTRPTSRMWVKTRSY------------------H |
| 667765471_Desulfonatronum_thiodismutans | 551 | ----------------------------------------KQHCHFFHDKAEKVAEHSRWRTETRPASSSWQDWRERRGYA----------------- |
| 497199019_Opitutaceae_bacterium_TAV5 | 552 | ----------------------------------------LLSQRDIIRRSFVQIANLILPIRGRWFWRPHVEVPDCHILA------QSDPGTDDTKRIVAGQ |
| 654153037_Tuberibacillus_calidus | 553 | ----------------------------------------VDQLKSIHRKLEHQLGKEILSKWRQSISQ-GRQG-------------------V |
| 75485389_Bacillus_thermoamylovorans | 554 | ----------------------------------------VAFIKQLIHRLEVIGKEVKHWRKSLSD-GRKG-------------------L |
| 495056180_Brevibacillus_sp-_CF112 | 555 | ----------------------------------------EQAVVQIHRKAEHVGKAVQAWRKRFAA-DERKG-------------------I |
| 651512544_Bacillus_sp-_NSP2-1 | 556 | ----------------------------------------EQAVVQIHRKAEHVGKAVQAWRKRFAA-DERKG-------------------I |
| Secondary_structure_for_651512544_(pred) | | ----------------------------------------HHHHHHHHHHHHHHHHHHHH---------------------------- |
| 654874074_Desulfatirhabdium_butyrativorans | 557 | AAKQLNDSRIATLAGYKAPENGDNVSDVAYRKKQQVREQLRVAKTLSGDVITCKKLSDAWKERWEDEDQWKKILRWFKDWVLPSGTQANNATIRNV |
| 652369729_Alicyclobacillus_herbarius | 558 | ---------------------------------------- |
| 652589403_Alicyclobacillus_contaminans | 559 | ---------------------------------------- |
| 411770298_Citrobacter_freundii_ATCC_8090 | 560 | ---------------------------------------- |
| 669372964_Citrobacter_freundii | 561 | ---------------------------------------- |
| 492410745_Brevibacillus_agri | 562 | ----------------------------------------EQAVVQIHRKAEHVGKAVQAWRKRFAADERKG-------------------I |
| 492410748_Brevibacillus_agri | 563 | ---------------------------------------- |
| 495062547_Brevibacillus_sp-_CF112 | 564 | ---------------------------------------- |
| 506407588_Methylobacterium_nodulans | 565 | ----------------------------------------QDTCKRAALYRTEFGAVVSEWRSRTRSREDRK-------------------Y |
| 219945206_Methylobacterium_nodulans_ORS_2060 | 566 | ---------------------------------------- |
| 760065057_Methylobacterium_nodulans | 567 | ---------------------------------------- |
| CONSENSUS_0.8 | | ........................................ |
| RuvC-like_motifs | | |

FIG. 13G-1

SEQ ID NO:

| SEQ ID | Organism | Sequence |
|---|---|---|
| 548 | 544084152_Alicyclobacillus_acidoterrestris | GGNSIHQIEYlEROYKFIKSKSFFGKVSGQ------VIRAEKGSX--FAITLREHDHAKEDRIKKLADRIIMEAIGYVVALDERGKGKW-------- |
| 549 | 652589596_Alicyclobacillus_contaminans | GGISLAHIEHLIQQRKLFPWSTHARTYGE------VRRLIPKHG--FAKRIQKHTNHVAEDRIKKLADMIVWAARGYRF---LDKRARW-------V |
| 550 | 652892497_Desulfovibrio_inopinatus | GGKSIWMLEVLDAVRKLLLSWSLKGRTYGA------INRQDTARFGSLASRLLHINSLKEDRIKTGADSIVQAARGYIP---LPHGKGW-------- |
| 551 | 667765471_Desulfonatronum_thiodismutans | GGKSYWAVTYLEAVGLIIRWMRGRTYGE------VNRQDKKQFGTVASALLHHINQLKEBRIKTGADMIIQAARGFVP---RKNGAGW-------- |
| 552 | 497199019_Opitutaceae_bacterium_TAV5 | RGISHERIEQLEILRRCQSINRAIRHRPGERPVLGRPAKGEETADPCPALLSKINRLRQVDQTAHAILAAHLGVLRAPSKDRAER--RHRDIHGEY-- |
| 553 | 654153037_Tuberibacillus_calidus | YGISIKNIEDIEKTRRLFPWSMRPENPGE------VKQLQPGER--FAIDQQNHLNLHKQDRIKKLANQIWTALGTRY---DGKKKW--------I |
| 554 | 754485389_Bacillus_thermoamylovorans | YGISLKNIEDIDRTRKFLLRWSIRPTEPGE------VRRLEPGQR--FAIDQANHINALKEDRIKKMANTIIMHAIGVCY---DVRKKW--------Q |
| 555 | 493056180_Brevibacillus_sp._CF112 | AGLSWMNIEHLEGIRKLLLSWSRKSRNPQE------VNRFERGHT--SHQRLLTHIQNVKEDRIKQLSHAIVWTALGIVY---DERKQEW-------C |
| 556 | 651512544_Bacillus_sp._MSP2-1 | AGLSWMNIEHLEGIRKLLLSWSRRTRNPQE------VNRFERGHT--SHQRLLTHIQNVKEDRIKQLSHAIVWTALGVYY---DERKQEW-------C |
| 557 | Secondary_structure_for_651512544_(pred) | -----HHHHHHHHHHHHHHHHHHHHHHHHHH------HHHHHHHHH--HHHHHHHHHHHHHHHHHHHHHHHHHHHH-----H--EE-------E |
| 558 | 654874074_Desulfatirhabdium_butyrativorans | GGLSLSRLATTEFRRKVQGFF-TRLRPD-----GTRHEIGEQ--FGGKTLDALELLREQRVKQLASRIEAALGTG----SEGGKGWDGGKRPRQRIN |
| 559 | 652569729_Alicyclobacillus_herbarius | |
| 560 | 652589403_Alicyclobacillus_contaminans | |
| 561 | 411770298_Citrobacter_freundii_ATCC_8090 | |
| 562 | 696372964_Citrobacter_freundii | AGLSWMNIEHLEGIRKLLLSWSRRTRNPQE------VNRFERGHT--SHQRLLTHIQNVKEDRIKQLSHAIVWTALGVYY---DERKQEW-------- |
| 563 | 492410745_Brevibacillus_agri | |
| 564 | 492410748_Brevibacillus_agri | |
| 565 | 495662547_Brevibacillus_sp._CF112 | AGKSWMSVQHLTDVRRFLQWSLACRASGD------IRRLDRERGGVFARDLLDHIDALKDBRIKTGADLIVQAARGF----QNMEGY-------W |
| 566 | 506407589_Methylobacterium_nodulans | |
| 566 | 219945206_Methylobacterium_nodulans_ORS_2060 | |
| 567 | 76065057_Methylobacterium_nodulans | |

CONSENSUS 0.8   .G.S......................................................R..A.I..A.G..........................

RuvC-like_motifs

```
SEQ ID NO:
54484152_Alicyclobacillus_acidoterrestris          548 ARCTQEHNPEPFPWMLNKFV----------VEHTLDACPLRADD----------LIPIGEGHFVSP-FSAEEGDFHQLHADLNAAQNLQQRLW
652588596_Alicyclobacillus_contaminans             549 KQDEKTPWLI-------------------QFAEITGVNTNVEPGQ----------LIPVDGGEWFVSPRKGPRAADGLKCVHADLNAAHNLQRRFW
652922497_Desulfovibrio_inopinatus                 550 ERDEFNDLPKPYLRELSWMLGNTKV-----ESEEEKRLISEKIRPGS---------LVPRDGGEQFATL--HPKKQTLCVLHADMAAQNLQRRFF
667765471_Desulfonatronum_thiodismutans            551 EEDFHDGLPGMHLVGELDWLLPKDKD----RTANEARLLIGGWRPGM---------LVPWSGGELFATL--NAASQLHVIHADLNAAQNLQRRFW
497199019_Opitutaceae_bacterium_TAV5               552 PDHRHRMPNSRILARLKAHEDGKRILEKTVLDEARAVRGLFDRLRPFNAGHVPGKPWRTLLAPLPGGPVVPL---GDATPMQADLNAAINLALRGI
654158037_Tuberibacillus_calidus                   553 EHELYITEGCQKVRAQKFLD----------SL---------VENNIIEPDDARRLEPGD------LIRQGGGDKFATL--DERGELVITHADLNAAQNLQKRFW
754858389_Bacillus_thermoamylovorans               554 K---------EKLQNRFFR----------NL----------QRHGRLTLDKIAVLKGD-------LVPDKGGEKPISL--SKDRKIVTTHADINAAQNLQKRFW
495056180_Brevibacillus_sp-_CF112                  555 GQDI------QGRRFENLQK----------RL----------VNEQFITEEQVKQLRPGD------IVPDDSGHLFMTLIDGSGSKEVFLQADINAAHNLQKRFW
651512544_Bacillus_sp-_NSP2-1                      556 GQDI------QGRRFENLQK----------RL----------VNEQFITEEQVKQLRPGD------IVPDDSGHLFMTLIDGSGSKEVFLQADINAAHNLQKRFW
Secondary_structure_for_651512544_(Jpred)              ---------------HHH--------HH---------HH------------EEEE-----------------EEEHHHHHHHHHHH-----
654874074_Desulfatirhabdium_butyrativorans         557 VREFMQSPFRKQVKQAEAKHDRNKG-----DARERFLCELNKTWKAKTPAEWKKAGFVRIPRGGHFVSA-DSKSPSAKGIHADLNAANIGLRAL
652569729_Alicyclobacillus_herbarius               558 ----------------------------------------------------------------------------------
652589403_Alicyclobacillus_contaminans             559 ----------------------------------------------------------------------------------
411770298_Citrobacter_freundii_ATCC_8090           560 ----------------------------------------------------------------------------------
696372964_Citrobacter_freundii                     561 ----------------------------------------------------------------------------------
492410745_Brevibacillus_agri                       562 GQDI------QGRRFENLQK----------RL----------VNEQFITEEQVKQLRPGD------IVPDDSGHLFMTLIDGSGSKEVFLQADINAAHNLQKRFW
492410748_Brevibacillus_agri                       563 ----------------------------------------------------------------------------------
495062547_Brevibacillus_sp-_CF112                  564 ----------------------------------------------------------------------------------
506407588_Methylobacterium_nodulans                565 KRFEFDQGFLELIKREN------------EGLDINGYKPGD---------LVPLPGGEVFVCL-------NAWGLSILHADLNAAQNLQRRFW
219945206_Methylobacterium_nodulans_ORS_2060       566 ----------------------------------------------------------------------------------
760065057_Methylobacterium_nodulans                567 ----------------------------------------------------------------------------------

CONSENSUS_0.8                                          ............................................................P...G.F..............AD.NAA.N..R..
RuvC-like_motifs                                                                                                                                D
```

FIG. 13G-4

```
                                                  SEQ ID NO:
54484152_Alicyclobacillus_acidoterrestris         548 SDFDISQIRLRCDNGEVDSLVLPRILGKRT------------------------------ADSYSNKFYTNGVTYFEREGKKRRVEAQEKLSEEEAELLVEADE
652589596_Alicyclobacillus_contaminans            549 IP---RLPSWKCRRIVEAECFAAVPSSTAFMKVHGKG-------------------AFVSVDGEFYEYQKGRRVAV----NRADRLSSTLDEDEGDIGEEMLVSSN
652932497_Desulfovibrio_inopinatus                550 GRCG-EARRIVCQPHGDDVLRLASTPGEARLLGALQQL------------------ENGQGAFELVRDMGSTSQMNRFVMKSLGKKIKPLQDNNGDDELEDVLSLPEE
667765471_Desulfonatronum_thiodismutans           551 GRCG-EARRIVCNQLSVDGSTRYMAKAPKARLLGALQQLKNGDAPFH.TSIPNSQKPENSYVMPTNAGKYRAGPGEKSSGEF---DELALDIVEQAEE
497199019_Opitutaceae_bacterium_TAV5              552 AAP--DRHDIHHRLRAENKRIISLR-----------------------------IGTQREKARMPGGAPAVTLSTPNNGASPEDSDALPERVSNLFTVDIAGV
654153037_Tuberibacillus_calidus                  553 TRTH-GLYRIRCESREIKDAVVNPSDKQKEKMENL------EGIGTLQPFKQENDVYKNVKGEKIKG--RKTSSQSDDKELV-SEIIQEASVMADE
754485389_Bacillus_thermoamylovorans              554 TRTH-GFYKVYCKAYQVDGGTVYIPESKQQKIIEE------FGEGV--FILKDGIVEWGNAGKLKI---KKGSSKQSSSELVDSDILKDSDTLASE
495056180_Brevibacillus_sp_CF112                  555 QRYN-ELEKVSCRVIVRDEEEYLVPKIKSVQAKLGKG-----LFVKKS--DTAMKDVIVWDSQAKLKG---KTTFTEESESPEQ-LEDFQEIIEEAEE
651512544_Bacillus_sp_NSP2-1                      556 QRYN-ELEKVSCRVIVRDEEEYLVPKIKSVQAKLGKG-----LFVKKS--DTAMKDVIVWDSQAKLKG---KTTFTEESESPEQ-LEDFQEIIEEAEE
Secondary_structure_for_651512544_(Jpred)             H-------EE--EEEE--EEEE----HHHHH--------EEE------EEEEE----HH------HH----H-HHHHHHHHH----
654874074_Desulfatirhabdium_butyrativorans        557 TDP-------DMPGKWWTVPCD------------------PVSFESKMDYVKCCAAVVGQPLRQPAQTNADGAASKIRKGKKNRTAG
652569729_Alicyclobacillus_herbarius              558 ................................................................
652539403_Alicyclobacillus_contaminans            559 ................................................................
411770298_Citrobacter_freundii_ATCC_8090          560 ................................................................
696372964_Citrobacter_freundii                    561 ................................................................
492410745_Brevibacillus_agri                      562 QRYN-ELEKVSCRVIVRDEEEYLVPKIKSVQAKLGKG-----LFVAKSDTAMKDVIVWDSQAKLKG---KTTFTEESESPEQ-LEDFQEIIEEAEE
492410748_Brevibacillus_agri                      563 ................................................................
495062547_Brevibacillus_sp_CF112                  564 ................................................................
506407588_Methylobacterium_nodulans               565 TQHG-DAFRLPCGKSAVQGIRMAPLSMGKRQAGALG------------------GFGTLEPTGHDSGSCQWRKTTEAEWRRLSCAQKDRDEAAAEDELQGEEEELLE
219995206_Methylobacterium_nodulans_ORS_2060      566 ................................................................
760065057_Methylobacterium_nodulans               567 ................................................................
CONSENSUS_0,8                                         ................................................................
RuvC-like_motifs
```

FIG. 13H-1

| SEQ ID NO: | | |
|---|---|---|
| 544894152_Alicyclobacillus_acidoterrestris | 548 | AREKSVILRDPSGIINRGN----WTRQKEMSMVQRIEGYLVKQIRSRVPLQDSACENTGDI------ |
| 652589596_Alicyclobacillus_contaminans | 549 | GAGEFVRMFYDESGYVGYG---RWMDSKIVWGKVPQIVHRAIQDQVEKRAAARGENGATSR------ |
| 652932497_Desulfovibrio_inopinatus | 550 | DDIGRITVFRDSSGIFFPCN---VWTPAKQTMPAVRAMWKVMASHLG------------------- |
| 667763471_Desulfonatronum_thiodismutans | 551 | LAQGRKTIFFRDPSGVFFAPD--RWLPSEITWSRIRRRIMQVTLERNSSGQERAMDEMPY------ |
| 497189019_Opitutaceae_bacterium_TAV5 | 552 | ANFERVTIEGVSQ----------KPATGRCLMASVQRAWNRVARLNETVDNNREEDDIPM------ |
| 654153037_Tuberibacillus_calidus | 553 | LKGNKKTLFRDPSGIVPPKD---RWVGGRYFGTLEHLLRKLAER---RLFDGGSSRRGLENGIDSNTNVE |
| 754485389_Bacillus_thermoamylovorans | 554 | LKGEKLMIYRDPSGNVFPSD---KWWAAGYFGKLERILISKLTNQYSISTIEDDSKQSM------- |
| 495056180_Brevibacillus_sp-_CF112 | 555 | AKGTVRTLFRDPSGVFFPES---VMYPQKDFWGEVARKLIVGKLRERFLTKAR------------- |
| 651512544_Bacillus_sp-_NSP2-1 | 556 | AKGTVRTLFRDPSGVFFPES---VMYPQKDFWGEVARKLIGKLREFLTKAR-------------- |
| Secondary_structure_for_651512544_(Jpred) | | ---EEEEEE----EEE---------HHHHHHHHHHHHHHHHHHHHHH-------------------- |
| 654874074_Desulfatirhabdium_butyrativorans | 557 | TSKERVIWRDISAPPLESNEIGENKETSAYQNDVQIRVIMLKEHIKSLDNRTGDNVEG-------- |
| 652256729_Alicyclobacillus_herbarius | 558 | ---------------------------------------------------------------- |
| 652258403_Alicyclobacillus_contaminans | 559 | ---------------------------------------------------------------- |
| 411770298_Citrobacter_freundii_ATCC_8090 | 560 | ---------------------------------------------------------------- |
| 696372964_Citrobacter_freundii | 561 | ---------------------------------------------------------------- |
| 492410745_Brevibacillus_agri | 562 | AKGTVRTLFRDPSGVFFPES---VMYPQKDFWGEVARKLIVGKLREFLTKAR------------- |
| 492410749_Brevibacillus_agri | 563 | ---------------------------------------------------------------- |
| 495062547_Brevibacillus_sp-_CF112 | 564 | ---------------------------------------------------------------- |
| 506407589_Methylobacterium_nodulans | 565 | RSGERVWFFRDPSGIVPLPTD--LWFPSAAFWSIVRAKTVGLRSHLDAQEASYAVAAGI------- |
| 219945206_Methylobacterium_nodulans_ORS_2060 | 566 | ---------------------------------------------------------------- |
| 760065057_Methylobacterium_nodulans | 567 | ---------------------------------------------------------------- |
| CONSENSUS_0.8 | | ................................................................ |
| RuvC-like_motifs | | |

| SEQ ID NO: | | |
|---|---|---|
| 568475111 Rhodobacter capsulatus R121 | 573 IYRKPDSRKSDGKAIHSPTPSKMQPDARDDI | GEAFWKLVSEAGL |
| 769144435 Lachnospiraceae bacterium MA2020 | 574 DLYDSQESDKSHKDKETISKGAKFVAKSFNS | AITILLKQNKYSFHTSQVIKELK |
| 551041827 Lachnospiraceae bacterium NK4A179 | 575 KLYRIFNEDKNKRETDELQWFLSEIVKKINRRNGLVLSDMLSVDDRAFEKAPFKYAELSYTNRRNKVSGSPAEPTCGVDAATAERLKGHISETNETNRIK | |
| 671463495 Clostridium aminophilum | 576 KAEEDDEKRFGKWKKNRELKDLLPHREV | SRYNSIGNAKYNYYGIKSNPEEIVSNL |
| Secondary Structure for 671463495 (Jpred) | HHHHHHHHHHHHHH | EEE----HHHHHHHHH |
| 652829192 Lachnospiraceae bacterium NK4A144 | 577 NTVDKVNNLDRVLFTGKSYDRKSITDIDTV | LRNVEKTNAFDRISTEER |
| 736546968 Carnobacterium gallinarum | 578 -SQKENKNATIKKNGDYISQIFEKLVGVDTN | KNIRKPKMSJTDJKDLPKKD |
| 736550717 Carnobacterium gallinarum | 579 TLVKADQVKGYKVLAENITITFEQLEKSNSE | KPSVYANNIRRLK |
| 503209049 Paludibacter propionicigenes | 580 TIIKEDTAKKQKLNVDQKIVEKIFKYPKQE | LPKQIKAEE |
| 502750493 Listeria seeligeri | 581 TICRPEQKQMKKLVHGLLQENSQEKIKVSDV | TKLN |
| 738100542 Listeria weihenstephanensis | 582 KLFKPK- | |
| 738133341 Listeria newyorkensis | 583 TVRKPDEKEKNRKQAINAINKETHIMLA | VLHQEVPSQKLHNLKSLNTES |
| 544240864 Leptotrichia wadei F0279 | 584 RIEKEDQNIKS----LYFFIKELYINEK | NEEWELKNINLE---ILDDK |
| 738101039 Leptotrichia wadei | 585 RIEKEDQNIKS----LYFFIKELYINEK | NEEWELKNINLE---ILDDK |
| 545623740 Leptotrichia wadei | 586 YIKNPENVKNKRDKDAEFKETKIRRTNLKKYFS | EIILKKEDEKYIL |
| 545623306 Leptotrichia wadei | 587 YIKNDNASEEE-----NRIRRENLKKFFS | NKVLHKDSVILHKNRKEKN |
| 506250229 Leptotrichia buccalis | 588 YIKNPSSTETKE-----NQKRIGLKKEFS | NKMVYLKDNTLSLKNGKKEN |
| Secondary structure for 506250229 (Jpred) | HH-----HHHHHHHHHHHH | HHHHHHHHHHHH---HHHH |
| 545661797 Leptotrichia sp oral taxon 225 | 589 | |
| 545620493 Leptotrichia sp oral taxon 879 | 590 NVLKEKERKFHAGNILFKLKGKEEIRIENN----DDFLETEEWVLYIE | VYGKSEKLKALETITKKKIIDEAIRQGITKDDK |
| 517267777 Leptotrichia shahii | 591 NILKEKERKFHAGNILFKLKGKEEIRIENN----DDFLETEEWVLYIE | AYGKSEKLKALETITKKKIIDEAIRQGITKDDK |
| CONSENSUS | | |
| HEPN (predicted RNAse) motifs | | |

```
                                                SEQ ID NO:
564875111 Rhodobacter capsulatus R121           573 AALYEHLVDEKRIDG---------------------------ARALGTESSVLPGM4LARAWGEERIQTYFVIVAASVKEVAKAAV
769144435 Lachnospiraceae bacterium MA2020      574 QPDSDSQVLSLSESSRREKQSSAVSSDTIVNCKEKDVIKAFLTDYAV-----------LDEDERNSLLWKLRNLVWHLYFYG-SESIRDYDY
551041827 Lachnospiraceae bacterium NK4A179    575 QPEGDGKF-AIIVSKGGTRSGNK------RSAEKEAFKKFLSDYAS-----------LDERVADDMLRMERIVVLLYFYGSDDSKLS-
671463495 Clostridium aminophilum              576 SIENQMAVQPSNEGDPITGITQGRPNSQKNEEKSATERMMSMYAD-----------INEDHREDVLRKLRRLNVLYFNVDTRKIEEPT-
Secondary Structure for 671463495 (Jpred)           HHH----------EEEEE-----------------------HHHHHHHHHHHEEEEEE-------
652829192 Lachnospiraceae bacterium NK4A144    577 SPVSRGEERIPDVSGAQKGKSSK------KAQZKEALSAFLLDYAD-----------LDKNVREYLRKLRRLINLYFVKNDDVMSLTE
736546968 Carnobacterium gallinarum            578 NSIEQNKGFSINPET--------------FSRKRRVLHQMAIEVQE-----------RGFPSIIDEKISKLAELYNFKRMCKRVQDEHNDLEKSMKKG-
736550717 Carnobacterium gallinarum            579 NSIOQNRGFSMPTAEEPNL----------LSRKQLFQQMAMKPQRSPLIQQMFAVEQNKEFANKINELAAVYNVDELCTAITEKG-
503209049 Paludibacter propionicigenes         580 KSIERNRI-DLTEN---------------LSRKKKALLAMETEFTA-----------SGSIDLTHYHKVYMTDVLCKMLQDV
502750493 Listeria seeligeri                   581 KSIRNNRIQST------------------ESRGQLMDRYMKDIIN------------KNKPFDIQSVSRKYQLEKLHSALKAIFK-
738100542 Listeria weihenstephanensis          582 KSIEQNKI-QSP-----------------DSPRKLVIQKVVTAFLN-----------GEPLGLDLVAKKYKLADLAEBSFKVV
738133341 Listeria newyorkensis                583 KSIEQNKI-QSP-----------------DSPRKLVIQKVVTAFLN-----------GEPLGLDLVAKKYKLADLAEBSFKLV-
544240864 Leptotrichia wadei F0279             584 KSINNNKI-NLEYKKENVNEEIYGINP--TNDREMTFYLLKEIIE-----------KKDEQKSILEEKLDNFDITNFLENIEKIFNEETE-----IN-
738101039 Leptotrichia wadei                   585 KSINNNKI-NLEYKKENVNEEIYGINP--TNDREMTFYLLKEIIE-----------KKDEQKSILEEKLDNFDITNFLENIEKIFNEETE-----IN-
545623740 Leptotrichia wadei                   586 KSLKTNKA-NVKKDSIKIGDDKYS-NVKGENKRSRIVEFVKKSENL----------KKFEENIRZAFEKIYTEENIKELYSKIEETLKKTHLKSTVREP-
545623306 Leptotrichia wadei                   587 YSFEEKKA-NVQKINENNVEKVGG-----KSKRNIIDYYRESAKR-----------NDTNNVQEAFDKLYKKEDIEKLKFPLIENSKKHEKKIREYYH-
506250229 Leptotrichia buccalis                588 YSFEEKKA-NVQKINENNVEKVEG-----KSKRNIIYDYRESAKR-----------DAVVSNVKEAFDKIYKEEDIAKLVEIENLTKLEKVKIREFYH-
Secondary structure for 506250229 (Jpred)           HHHH------HHH-------------------HHHHHHHHHHHHHE----------HHHHHHHHHHHH--HHHHHHHHHHHHHH-
545661797 Leptotrichia sp oral taxon 225       589 ----------------------------------------------------------------------------------
545620493 Leptotrichia sp oral taxon 879       590 TNFMETRE-KIKSNLETMGFVKFYLNVSGDKKKSENKNMVEKT--------------LN-TNVDLIVEDIVDE-IVKELKFWNITKRIEKVKFNEFLENRNRTY-
517267777 Leptotrichia shahii                  591 TNFMETRE-KIKSNLETMGFVKFYLNVGGDKKKSKNKNMVEKT--------------LN-INVDLIVEDIVDIKIEKFWNITKRIEKVKVNEFLEKRRNRTY-
CONSENSUS
HEPN (predicted RNAse) motifs
```

| SEQ ID NO: | | | | | |
|---|---|---|---|---|---|
| 564875111 Rhodobacter capsulatus R121 | 573 | SAAQAHDPP------- | -------------- | ---------------- | RQVSGRSLSPKV-GFALAEHLERV------------TGSKRCSFDPAAG |
| 769144435 Lachnospiraceae bacterium MA2020 | 574 | TKEKSWKEHDEQK---- | ANKILEIDEICHITK | ---------------- | IGKNGKEQVLD-VEENRSRCRKQ------------NINYYRSALNYAKNN |
| 551041827 Lachnospiraceae bacterium NK4A179 | 575 | ---DVNEKPDVW----- | ---------------- | ---------------- | EDHAARVDNREDKLPIENKLA-NGKTDKDAERIR-KNTVKELYRNQ------------NIGCYRQAVKAVEED |
| 671463495 Clostridium aminophilum | 576 | LPGEVDNPVFEVW---- | ---------------- | ---------------- | HDHEKGKENDRQEATFAKILTEDRETRKKELAVKEA--INDLKSAIRDH------------NIMAYRCSIKVTEQD |
| Secondary Structure for 671463495 (Jpred) | | ----HHH---------- | ---------------- | ---------------- | ----HHHHHHH-----------HHHHHHHH-------------HHHHHEEEEEE---- |
| 652829192 Lachnospiraceae bacterium NK4A144 | 577 | IPAEVNLEKDFDIW--- | ---------------- | ---------------- | RDHEQSKEENGDEVGCPDILLADRDVKKSNSKQVKIA--EROLRESIREK------------NIKRYRFSIKTIEKD |
| 736546968 Carnobacterium gallinarum | 578 | ---------------- | ---------------- | ---------------- | KNPEKEKEAVKKQRNFKIKTIWKDY------------PYKTHIGLI--- |
| 736550717 Carnobacterium gallinarum | 579 | ---------------- | ---------------- | ---------------- | MNFDKDKSNKTR-NFEIKLWKQH------------PHNKDKALI--- |
| 503209049 Paludibacter propionicigenes | 580 | ---------------- | ---------------- | ---------------- | KPLTDDKGKINT-NAVHRGLKKAL------------QNHQPALFGTREV |
| 502750493 Listeria seeligeri | 581 | ---------------- | ---------------- | ---------------- | EAKKNDKEI--NYKLKSTLQNH------------ERQII--- |
| 738100542 Listeria weihenstephanensis | 582 | ---------------- | ---------------- | ---------------- | DINEDKSA-NYKIKACLQQH------------QRNIL--- |
| 738133341 Listeria newyorkensis | 583 | ---------------- | ---------------- | ---------------- | DINEDKSA-NYKIKACLQQH------------QRNIL--- |
| 544240864 Leptotrichia wadei F0279 | 584 | IIKGKVIANELREYI-- | KEKEE---------- | ---------------- | NNSDNKLKQIY-NLELKKYIENN------------FSYKK--- |
| 738101039 Leptotrichia wadei | 585 | IIKGKVIANELREYI-- | KEKEE---------- | ---------------- | NNSDNKLKQIY-NLELKKYIENN------------FSYKK--- |
| 545623740 Leptotrichia wadei | 586 | YQNEIIGESEFSKKNGDGISIYNQIKDST | ---------------- | ---------------- | KKEENFIEFIENTGNLELKELIKSQ------------IFYKYFI--- |
| 545623306 Leptotrichia wadei | 587 | KIIGRNDKENFAK---- | IIYEEI--------- | ---------------- | QNVNNIKELIEK-IPDMSELKKSQ------------VFYKYYI--- |
| 506250229 Leptotrichia buccalis | 588 | EIIGRNDKENFAK---- | IIYEEI--------- | ---------------- | QNVNMKELIEK-VPDMSELKKSQ------------VFYKYYI--- |
| Secondary structure for 506250229 (Jpred) | | HHH------------- | HHHHHH--------- | ---------------- | H----HHHHHHHH---------------HHHHHHH---- |
| 545661797 Leptotrichia sp oral taxon 225 | 589 | ---------------- | ---------------- | ---------------- | MKDLIDK-VPNVSELKKSQ------------VFYKYYI--- |
| 545620493 Leptotrichia sp oral taxon 879 | 590 | IKSYVILDKHEERK--- | IERENKDKIVAFFVENIKN | ---------------- | NSIKEKEKILA-EFKINELIKKLLEKELKKGNCDTEIFGIFKKHYKVNFDSKKF |
| 517262777 Leptotrichia shahii | 591 | IKSYVILDKHEERK--- | IERENKDKIVAFFVENIKN | ---------------- | NSIKEKEKILA-EFKIDELIKELKELKKGNCDTEIFGIFKKHYKVNFDSKKF |
| CONSENSUS | | ................ | ................ | ................ | ................................................ |
| HEPN (predicted RNAse) motifs | | | | | |

| | SEQ ID NO: | | | | |
|---|---|---|---|---|---|
| 564875111 Rhodobacter capsulatus R121 | 573 | PSVIAL------------HDEVKKT----------VKRLCARGNAARHPADKTELLAL-MRHTHENVRNQMVRM------GRVSEVRGQQAGD |
| 769144435 Lachnospiraceae bacterium MA2020 | 574 | TSGIFE---NEDSHFWIHLI-ENEVRLYNGINGEEFKFETGYISKVWKAV-INHLSKVIALGKAVYNVMKELSSP------GDIEPG--KIDDS |
| 551041827 Lachnospiraceae bacterium NK4A179 | 575 | NNGRYF-DDKMLNMFFIHRI-EYGVEKIYANLKQVTEFKARTGYLSEKIWDL-INVISKVIAMGKAVIVAMDELNASDKKEHLGKISEE--YLSG- |
| 671463495 Clostridium aminophilum | 576 | KDGLFF-EDQRINRFWIHHI-ESAVRILASINPEKLVKIYLRIGYLGKVWDL-LNVLSKVIAVGAVFHFMEDLGKT-GQDIELGKLSNS--VSGG- |
| Secondary Structure for 671463495 (Jpred) | | ---------HHHHHHHH----HHHHHHHH-------HHHHHHH-----HHHHHHHHHHHHHHHHHHHH------EEEE--HHHH--H--- |
| 652829192 Lachnospiraceae bacterium NK4A144 | 577 | -DGTFFANKQISVFWIHRI-ENAVERILGSINDKKLYKLRLGYLGEKVWDL-LNFLSKVIAVGKAVFNFMDDLQEK-DRDIEPGKISEN--AVNGL |
| 736536968 Carnobacterium gallinarum | 578 | -EKIKE--NEELNQF------NIEIGKY---EEHYFPIKKERCTEDEPYY----INSETTATT-VNVQLKNALISYLMQI------GKYKQF-GLENQ |
| 736550717 Carnobacterium gallinarum | 579 | -KLFNQEGNEALNQF------NIELGKY---EEHYFPKTGKKESAES------YY-LNPQTIKT-VGYQLRNAIRANIIQQ------GKLHQY--NKG |
| 503209049 Paludibacter propionicigenes | 580 | PNEANR-ADNQLSIY------HLEWVKY---LEHYFPIKTSKRRNTADDIAHV-LKAQTKYT-TEKQLVNAIRANIIQQ------GKTNHH-ELKAD |
| 502750493 Listeria seeligeri | 581 | -EEIKE--NSELNQF------NIERKH---LETYFPIKKINRKVGDIRN----LEIGHQKI-VAHRLKNKIVQRILQE------GKLASY--EIES |
| 738100542 Listeria weihenstephanensis | 582 | -DELKE--DPELNQY------GIEVKKY---IQRYFPIKRAPNR-SKHARADE-LKKELIEST-VEQQFKNAWVHYVLEQ------GKMEAY--ELID- |
| 738133341 Listeria newyorkensis | 583 | -DELKE--DPELNQY------GIEVKKY---IQRYFPIKRAPNR-SKHARADE-LKKELIEST-VEQQFKNAWVHYVLEQ------GKMEAY--ELIDP |
| 544240864 Leptotrichia wadei F0279 | 584 | QKSKS--KNGKNDYL------------------YLNFLKKIMFIEEVDEKKE-INKEKFKNK-INSNFKNLFVQHILDY------GKLLYI--KENDE |
| 738101039 Leptotrichia wadei | 585 | QKSKS--KNGKNDYL------------------YLNFLKKIMFIEEVDEKKE-INKEKFKNK-INSNFKNLFVQHILDY------GKLLYI--KENDE |
| 545623740 Leptotrichia wadei | 586 | -ENEEL--NDENIKFAFCYIVEIEVMNL----IKENVYKIKRFNESNKKRIENI-FEVGKLKKL-IVYKLENKLNYVRNC------GKYNVH--MENGD |
| 545623306 Leptotrichia wadei | 587 | -DKEEL--NDKNIKVAFCHFVEIEMSQI----LKNY--VVKRLSNISNDKIKRI-FEYQNLKKI-IENKLINKLDTYVRNC------GKYNYI--LQVGE |
| 506250229 Leptotrichia buccalis | 588 | -DKEEL--NDKNIKVAFCHFVEIEMSQI----LKNY--VVKRLSNISNDKIKRI-FEYQNLKKI-IENKLINKLDTYVRNC------GKYNYI--LQDGE |
| Secondary structure for 506250229 (Jpred) | | -HHHH------EEEEEHHHHHHHHH------HHHH--H-------HHHHHHH--HHH--EHHH--HHHHHHHHHHHHHHHH------EEEH--HH--- |
| 545661797 Leptotrichia sp oral taxon 225 | 589 | -NKEKL--NDENIKVVFCHFVEIEMSKL----LKNY--VVKKPSNISNDKVKRI-FEYQSLKKL-INESLISEK-ILKRVKQYTLEHIMYL------GKYSFY--LQDGE |
| 545620493 Leptotrichia sp oral taxon 879 | 590 | SNKSDE--EKELVKLIYRYL-KGRIEKI----LWNE--QKVRLKMEKIETEKI-LNESLISEK-ILKRVKQYTLEHIMYL------GKLRHN--DIVKM |
| 517262777 Leptotrichia shahii | 591 | SNKSDE--EKELVKLIYRYL-KGRIEKI----LWNE--QKVRLKMEKIETEKI-LNESLISEK-ILKRVKQYTLEHIMYL------GKLRHN--DIDMT |
| CONSENSUS | | ..........................................................................i..............N.............GK........ |
| HEPN (predicted RNAse) motifs | | | | | |

| SEQ ID NO: | | |
|---|---|---|
| 564875111 Rhodobacter capsulatus R121 | 573 | ------------GIYFGETPELDRLGAEGNEGFVFALLRYLRGCRNQTFHLGARAGFLKE--------------- |
| 76914435 Lachnospiraceae bacterium MA2020 | 574 | ------WGGYSTWKN-FCE--EYLKDDKD-ALELLYSLKSMLYSMNSSFHSTENVDNG--------------- |
| 551041827 Lachnospiraceae bacterium NK4A179 | 575 | DTILQIFGGHSLRMDFPFD--KYLAGGKD-DVDFLTDLKDVIYSMRNDSFHYATENHNNG--------------- |
| 671463495 Clostridium aminophilum | 576 | -GGASSMDLN-HCAAYGN--ESSALGVE--TKFADDIRKAIYSLRNETFHFTLNKGSF--------------- |
| Secondary Structure for 671463495 (Jpred) | | -H--HHHHH---------------HHHHHHHHHHH------EEEEE--------------- |
| 65829192 Lachnospiraceae bacterium NK4A144 | 577 | -----FGGASTRNMKMFET-AYHDQPGDYEENVLYDIQIIYSLRNKSFHKTYDJGCK--------------- |
| 73546968 Carnobacterium gallinarum | 578 | FELKGMDRESELIP-FGE--QTEAKQMQ---NIWA-LRGSVQQTRNEIFHSFDKNQKFN--------------L- |
| 73655717 Carnobacterium gallinarum | 579 | ------PAK--KIAMTPNE--LDLWA-LRGAVQRVRNQIFHQ-QINKRHEP--------------- |
| 50309049 Paludibacter propionicigenes | 580 | ------FPGE--GLSTNKAEKETQLMG--IRGAVQQIRNIVNHY--KKDALK--------------- |
| 502750493 Listeria seeligeri | 581 | ------RSQFFSQ--EIYVDDIE--LASWG--LRGAIAPTRNEIIH---KKHSWKKF------FNN-- |
| 738101542 Listeria weihenstephanensis | 582 | ------FSD--EIQNVNFD--EAIWA-IRGSIQQIRNEVYHC--KKHSWK--------------- |
| 738133341 Listeria newyorkensis | 583 | ------FSD--EIQNVNFD--EAIWA-IRGSIQQIRNEVYHC--KKHSWK--------------- |
| 544240864 Leptotrichia wadei F0279 | 584 | ------YFF--DFEIFDANKIVELESISYSIYNVNGVGHF-NKLLIGK--------------- |
| 738101039 Leptotrichia wadei | 585 | ------YFF--DFEIFDANKIVELESISYSIYNVNGVGHF-NKLLIGK--------------- |
| 545623740 Leptotrichia wadei | 586 | FQKKGTVMIKENLKMFYGD--SFDNADKDEKQFFVMLNAITSLRHRVVHI-MMVTNSE--------------- |
| 545623306 Leptotrichia wadei | 587 | ------EVKENLKMFYSY--DFNMDNKNEIEDFFANIDEAISSLRHGIVHF-NLEEGK--------------- |
| 506250229 Leptotrichia buccalis | 588 | ------EVKENLKMFYSY--DFNMDNKNEIEDFFANIDEAISSLRHGIVHF-NLEEGK--------------- |
| Secondary structure for 506250229 (Jpred) | | ------EEE--------------HHHHHHHHHHHHHHHH--HHEE--------------- |
| 545661797 Leptotrichia sp oral taxon 225 | 589 | ------EVKKNLKMFYSY--DFNMNSGKEIEDFFSNIDEAISSLRHGIVHF-NLEEGK---YGNIQETKNLKGEYENVEKLIKELKVSDEEI-SKSLSLD |
| 545820493 Leptotrichia sp oral taxon 879 | 590 | ------YSPQEGYLLRNKILENS---------------- |
| 517262777 Leptotrichia shahii | 591 | ------FKIFTNERRILHA---ISKERDLQGTQDDYNKVINIQNLKISDEEV-SKAINLD |
| CONSENSUS | | ....................................RN..H....... |
| HEPN (predicted RNAse) motifs | | ....................................R..H....... |

FIG. 13K-4

```
                                             SEQ ID NO:
564875111 Rhodobacter capsulatus R121         573  IRKELEKTRWGAKEAEHVLIDKVVAAIRAIIDNDAK--ALGARLLADLSGAFVAHVAS------KEHF-------STLJ---SEIVKAVKDAPEVS
769144435 Lachnospiraceae bacterium MA2020    574  ----------------------------------SWDELIGHLREEDCN--RAARTKEKFYNNWLHMFYS------SSLI--IKVLERMY---SSHHER----ASQV-
551041827 Lachnospiraceae bacterium NK4A179   575  ----------------------------------KWNKELISAMFEHETE--RMTVVMCDKFYSNNLPMFYK------NDDL--KKLLIDY---KDNVER----ASQV-
671463495 Clostridium aminophilum             576  ----------------------------------DWNAKLIFDMFSHEAA--TGTAVRTRFYSNNLPMFYR------ESDL--KRIMDHLY--NTYHPR----ASQV-
Secondary Structure for 671463495 (Jpred)          --------------------------------------------------------------------HH-----HHHH---HHHHHHHH---H--------------
652829192 Lachnospiraceae bacterium NK4A144   577  ----------------------------------NWNRELIGKMEHDAE--RVISWREKPHSNLPMFYK------DADI--KKILDLY---SDYAGR----ASQV-
736546968 Carnobacterium gallinarum           578  POLDKSNFEFDASENSTFKSQ-SYITDYKTLFEAEKN--QLEQFIIERIKSSGALEVYP------IKSLEKLRAKKEMKF-----SLGSQV---VAFA-
736550717 Carnobacterium gallinarum           579  NQLKVGSFENGDLGNV------SYQKTIYQKLFDAEIK--DIEITYAEKIKSSGALEQYS------MKDLEKIFSNKEITL-----SLGGQV---VAFA-
503209049 Paludibacter propionicigenes        580  TVFNISNFENPITDPKQQI---NYADTIYKARFINELE--KIPEAFAQQLKTGCAVSYYI------IENL--KSLITTQF-----SLCRST---IPFA-
502750493 Listeria seeligeri                  581  PTFKVAKSKTINGKTKDVYSEFLYKTLFKDYYSEID--SVPELINKMESSKILDYYS------SDQLNQVDTIPNREL-----SLLTSA---VPFA-
738100542 Listeria weihenstephanensis         582  SILKIKGFEFEPNNM-------KYTDSDMQKLMDKDIA--KIPDFIEEKLKSSGIRFYS------HDKL--QSINEMKQGF----SLLTTN---APFV-
738133341 Listeria newyorkensis               583  SILKIKGFEFEPNNM-------KVADSDMQKLMDKDIA--KIPEFIEEKLKSSGIRFYR------HDEL--QSINEMKQGF----SLLTTN---APFV-
544240864 Leptotrichia wadei F0279            584  ---YKKDINTNKRIEED-----INNNEEIKGYFIKKRG--EIERKVKEFLSNWLQYIYS------REKI--ENVFEVYEF----EILKRK---IPFA-
738101039 Leptotrichia wadei                  585  ---YKKDINTNKRIEED-----LNNNEEIKGYFIKKRG--EIERKVKEFLSNWLQYIYS------REKI--ENVFEVYEF----EILKRK---IPFA-
545623740 Leptotrichia wadei                  586  NIFNPSG---------------IEVSKLLKSIFEKETDKRELKLKIFRQLNSAGVFDVWE-----NRKI--DKYLENIEF----KEVNKN---IPFV-
545623306 Leptotrichia wadei                  587  DIFAFKN---------------IAPSEISKKMFQNEINEKKLKLKIFQLNSANVFNVYE------KDVI--IKYLKNTKF----NFVNKN---IPFV-
506250229 Leptotrichia buccalis               588  DIFAFKN---------------IAPSEISKKMFQNEINEKKLKLKIFRQLNSANVFRYYE-----KYVI--LNVLKRTRF----EFVNKN---IPFV-
Secondary structure for 506250229 (Jpred)          --------------------------------------------------HHHHHHHHH---HHHH--HHHHHHHHH----HHH-----------
545661797 Leptotrichia sp oral taxon 225      589  DIFTFKN---------------IVPSQISKKMFIDEINEKKLKLKIFRQLNSANVFRYLE-----KYKI--INVLNRTRF----EFVNKN---IPFV-
545620493 Leptotrichia sp oral taxon 879      590  VIFEGAVDIINKNS--------LKGEVKDKKYIPSFS--KIVLEJTRKFREINDKLFD--IESEKIINAVKYVNKILY------EKITSNEE-NEFLK
517262777 Leptotrichia shahii                 591  VVFKDKNITKANDIK-------ISENNNDIKYIPSFS--KVLPEIINLYRNNPKNEPDTIETEKIVNALIYVNKELIEEDLEENESKNITL-
CONSENSUS                                          .........................................................................L..................
HEPN (predicted RNase) motifs
```

FIG. 13L-1

| SEQ ID NO: | | | |
|---|---|---|---|
| 564875111 Rhodobacter capsulatus R121 | 573 | SGLPRLKLLIKRADGVRGVVHGLRDTRKHAFATAKLPPPPAPRELDDPATKARYIALIRLVDGPFRA | YASGITGTALAGPAARA |
| 769144435 Lachnospiraceae bacterium MA2020 | 574 | ---PSNRVFVRKNFPSSLSEQR---------ITPKFTDSK-DEQIWQSAVYLCKEITYNDFIQ | SK--EAYKLIREGVKNL |
| 551041827 Lachnospiraceae bacterium NK4A179 | 575 | ---PSENRVFVRKN-FPALVRDKDNLGIELD--LKADADKGE-NELKFVNALIYMPKEITYNAFLNDKNVREPITKATKVADNYDNKERNKDRIKSA | |
| 671463495 Clostridium aminophilum | 576 | ---PSENSVFVRKNFRLFLSNTLN-------TNTSFDIE---VYQKWESGVYLFKEIYNSFLP | SG--DAHLFFEGLRRI |
| Secondary Structure for 671463495 (Jpred) | | EEEE | HHHHHHHHHHHHHHH |
| 652829192 Lachnospiraceae bacterium NK4A144 | 577 | ---PANTVLVRKNFPEFLRKDMG-----------YKVHFNNPE-VENQWHSAVYLYKEIVNLFLR | DK--EVKNLIYTSLKNI |
| 736546968 Carnobacterium gallinarum | 578 | ---PSYKKLVKKGH--SYQTATEGTAN-YL--GLSYVNRYE-LKRESFQAQYLLKLIYQVVELP | NFSQGNSPAIRETVKAI |
| 736550717 Carnobacterium gallinarum | 579 | ---PSYKKLYKQGI----FVQNEKT-----I---ELEQFTDYD-FSNDVFKANYLLIKLIYHYVELP | QFSQANNKLFRDTVHYV |
| 503209049 Paludibacter propionicigenes | 580 | ---PGEKKVFNGGI----NVGNAKQDES--FVELMLEQYLRKENFABESYNARVYMLKLIYNNLFLP | GFT--TDRKAFADSVGFV |
| 502750493 Listeria seeligeri | 581 | ---PSFKRVILKGF---DYQNQDEAQPDYNL--KLNIYNEKA-FNSEAFQAQYSLFKMVYQVFLP | QFT--TNNDLFKSSVDFI |
| 738100542 Listeria weihenstephanensis | 582 | ---PSFKRVYAKGH----DYQTSKNR----YVDLGLTTFDILE-YGEEDFRARYFLTKLVYQQFMP | WFT--ADNNAFRDAANFV |
| 738133341 Listeria newyorkensis | 583 | ---PSFKRVYAKGH----DYQTSKNR----YVNLDLTTFDILE-YGEEDFRARYFLTKLVYQQFMP | WFT--ADNNAFRDAANFV |
| 544240864 Leptotrichia wadei F0279 | 584 | ---PNFKRIIKGEE---DLFNNKAINKKYEYF--KNFDKANSAE-EKKEFLKTRNFLLKELYNNNFYK | EFL--SKLEEELOVLEV |
| 738101039 Leptotrichia wadei | 585 | ---PNFKRIIKGEE---DLFNNKAINKKYEYF--KNFDKANSAE-EKKEFLKTRNFLLKELYNNNFYK | EFL--SKLEEELOVLEV |
| 545623740 Leptotrichia wadei | 586 | ---PSFFKLVNRID---NLKGNNAL-----FW--NLGYINIPK--RKEARDSQYLLKNIYGEFVI | KFV--NNNDNEKIFREI |
| 545623306 Leptotrichia wadei | 587 | ---PSFFKLYNKIE---DIRNTLKF-------FW--SVP-------KDEEKDAQYLLKNIYGEFIN | KFV--RNSKVFKITNEV |
| 506250229 Leptotrichia buccalis | 588 | ---PSFFKLYSRID---DLKNSLGI-----YW--KTPKTNDDN-KIKEIIDAQYLLKNIYGEFLN | YFM--SNNGNFELSKEI |
| Secondary structure for 506250229 (Jpred) | | HHHHHHHH---HHHHH | EE | HHHHHHHHHHHHHHH |
| 545661797 Leptotrichia sp oral taxon 225 | 589 | ---PSFTKLYSRID---DLKNSLCI-----YW--KIPKANDNN-KIKEIIDAQYLLKNIYSEFLN | YFM--SNNGNFFELIKEI |
| 545620493 Leptotrichia sp oral taxon 879 | 590 | TLPDKLVKKSNNK---ENKNLLSIEE--YY--KNAQVSSSK-GDKKAIKKVQNKVTNAVLEYLEN | TF--TEIIDSKFNLNY |
| 517262777 Leptotrichia shahii | 591 | ---QEIKKTIGNID---EIDENI--IEN-YV--KNAQISASK-GNNKAIKKVQKKIVECVIGYERK | NY--EELFDFSDFKMNI |
| CONSENSUS | | ......P......................Y..F..........F |
| HEPN (predicted RNAse) motifs | | | |

FIG. 13L-2

| | SEQ ID NO: | | | |
|---|---|---|---|---|
| 564875111 Rhodobacter capsulatus R121 | 573 | ----KAATALAQSVNVTKAYSDVMEGRSSRLRPPNDGFLREYLSALTGFPATEFRVQLGYESDSENARKQAFF--- | IENVRRDMLAF--- | MFEDYI--R |
| 769144435 Lachnospiraceae bacterium MA2020 | 574 | ----DKNDINNQKAAD-SFKQ---------- | AVYYGKAIGNAFLSQVCQAIMTEYARQNNDGLKKKSAVAEKQNSNKYKHYPLFKQVLQS-- | AFWEYLDEN--K |
| 551041827 Lachnospiraceae bacterium NK4A179 | 575 | ----GSDEKKKLREQLQ-NVIAENDFCQRIKNIVQVNPDYLAQICQLIMTEVNQQNNGMQKKSAARKDINKDSYQHYKMLLVNEK--- | AFEEFI--K |
| 671463495 Clostridium aminophilum | 576 | ----KREADNLPIVGKE-AKKR---------- | NAVQDFGRRCDELIKNLSLSAICQMIMTEYAEQNNGNRKVKSTRDKRKPDIFQHYKMLLRTLQE--- | AFAIYI--R |
| Secondary Structure for 671463495 (jpred) | | --H--HHHH----HHHHH-------------HHHHHHHHH-----HHHHHHHHHHH----- | HHHHHH--H |
| 652829192 Lachnospiraceae bacterium NK4A144 | 577 | ----RSEVSDKK-QKLA--- | SDDFASRCEIEDRSLPEICQIIMTEYNAQNFGNRKVKSQVIEKNDIFRHYKMLLKTLAG--- | AFSLYL--K |
| 736546968 Carnobacterium gallinarum | 578 | ----IRINKDEARKKM-KNNKKFLRKYAFEQVREMEFKETPDQYMSVLQSEMREEKVRKAEHKNDKGFEKNITMNF--- | EKLLMQIFVK--- | GDVFLITF |
| 736550717 Carnobacterium gallinarum | 579 | IQQNKELNTERDKKN-NKKI---------- | RKYAFEQVK-LMKNESPEKYMQYLQREMQEERT---- | IKEAKKTNEEKPNV-NFEKLLIQIFIK--- | GFDIFL--R |
| 503209049 Paludibacter propionicigenes | 580 | ----QMQNKKQAEKVN-PRKK---------- | EAYAFEAVRPMTAADSIADYMAYVQSELNQEQN----- | KKEEKVAEETRINF--- | EKFVLQVFIK--- | GFDSFL--R |
| 502750493 Listeria seeligeri | 581 | ----LILINKERKGYAK---- | AFQDIRKMNKDEKPSEYMSYIQSQML------- | YQKKQEKEKINE--- | EKFINQVFIK--- | GFNSFI--E |
| 545233306 Leptotrichia wadei | 582 | ----IRINKNRQQDAK---- | AFINREVEEGEMPRDYMGYVQQGTAT------- | HEDSTEDTPNHF--- | EKFISQVFIK--- | GFDSHM--R |
| 758133341 Listeria newyorkensis | 583 | ----IRINKNRQQDAK---- | AFINREVEEGEMPRDYMGYVQQGTAT------- | HEDSTEDTPNHF--- | EKFISQVFIK--- | GFDRHM--R |
| 544240864 Leptotrichia wadei F0279 | 584 | ----KEEKKSRGNINN-KKSG---------- | VSFQSIDDYDYTKINISDYIASIHKKEME------- | RVEKYNEEKQKDTAKYIRDFVEEIEIT--- | GFINYL--E |
| 738101039 Leptotrichia wadei | 585 | ----KEEKKSRGNINN-KKSG---------- | VSFQSIDDYDYTKINISDYIASIHKKEME------- | RVEKYNEEKQKDTAKYIRDFVEEIEIT--- | GFINYL--E |
| 545623740 Leptotrichia wadei | 586 | ----IEINKKDINTK-TKF---------- | YKLEKEYLKANA-PIEVLKIQSLHQI------- | NYNREKVEEDKDIY--- | VDFVQKIFLK--- | GFINYL--Q |
| 545623306 Leptotrichia wadei | 587 | ----IKINKQ-RNQK-TGH---------- | YKYQKENIEKTV-PVEVLAIIQSREMI------- | NWQDKEEKNTY--- | IDFIQKIFLK--- | GFIDYL--N |
| 506250229 Leptotrichia buccalis | 588 | ----IEINKNDKRNLK-TGF---------- | YKLQKEFDIQEKI-PKEYLANIQSLYMI------- | NAGNQDEEEKDIY--- | IDFIQKIFLK--- | GFMTYL--A |
| Secondary structure for 506250229 (Jpred) | | -------HHHHHHHH---- | ------EEHHHHHHH-------- | ---HHH------- | HHHHHHHHHH-- | HHHHHH--H |
| 545661797 Leptotrichia sp oral taxon 225 | 589 | ----IRINKNDKRNLK-TGF---------- | YKLQKEFNLQEKT-PKEYLANIQSFYMI------- | DAGNKDEEEKDAY--- | IDFIQKIFLK--- | GFMTYL--A |
| 545620493 Leptotrichia sp oral taxon 879 | 590 | ----DEIKTKIEBRKD-NKSK---------- | IIIDSISTNNITNDIEYIISIFAL------- | LNSNTVINKIRNRF--- | FATSVWLEKQNGIKEYDYEN |
| 517262777 Leptotrichia shahii | 591 | ----QEIKKQIKDIND-NKT---------- | YERITVWTSDKTIVINDDFYIISIFAL------- | LNSAVINKIRNRF--- | FATSVWLN----- |
| CONSENSUS | | | | ...F..Y..... |
| HEPN (predicted RNAse) motifs | | | | I... |

| SEQ ID NO: | | |
|---|---|---|
| 564875111 Rhodobacter capsulatus R121 | 573 | -------TIARPAEDDPE----------GD-GASEPLRVARILRGLRQI-------ARVNHAVLSDIFAKHKVRDEVARLARIEDEI-----Q |
| 769144435 Lachnospiraceae bacterium MA2020 | 574 | ---NFGDVHSGAAINAFCNSES-EGKKNGIYYD-GIN----PIV-NRNWVLC------KLYGSPDLISKIIS------R---VNKMIHDFH---- |
| 551041827 Lachnospiraceae bacterium NK4A179 | 575 | -DFEYDGGNYKDSINRFCNSDAVNDQKVALYYD-GEH----PKL-NRNILLS------KLYGERRFLEKITD------R---VSRSDIVEYY---K |
| 671463495 Clostridium aminophilum | 576 | KDEKIAEVSSFAALKTFCNEE----EVKAGIYMD-GEN----PVM-QRNIVMA------KLFGPDEVLKNVVP-------K---VIREEIEEYY---Q |
| Secondary Structure for 671463495 (Jpred) | | -----HHHHH-----------------HH-HHHHHH-------H---HHHHHHH------H |
| 652829192 Lachnospiraceae bacterium NK4A144 | 577 | DAIKELSGSSYAALDHFCNKD----DLKFDIYVNAGCK----PIL-QRNIVMA------KLFGPDNILSEVME-------K---VIESAIREYI---D |
| 736546968 Carnobacterium gallinarum | 578 | ---------------TAPY----VQID-DRT----RVS-FRPILKL------EKVHTKSLIEALLKDNPQFR----VAAIDIQEWM---H |
| 736550717 Carnobacterium gallinarum | 579 | ---KVELAKNEPY--------MQED-KLF----PVK-FRFMKQL------EKVQTRNFIENLVIENPEEK----VSEKIVLNWI---E |
| 503209049 Paludibacter propionicigenes | 580 | ---EQGADITNWSDLF--------VQSD-KHS----PVI-HANIELS------VKVGTTKLLEQIINKDTQFK----TTEANFTAWN---T |
| 502750493 Listeria seeligeri | 581 | ---SEELLQSIPY---------TQED-GQT----PVI-NRSIDLV------KKYGTETILEKLFSSSDDYK----VSAKDIAKLH---E |
| 738100542 Listeria weihenstephanensis | 582 | ---GEELYQREPY---------RSQD-GKT----PIL-FRGVEQA------RKYGTEVIQRIEDASPEEK----VSKONIIEWE---R |
| 738133341 Listeria newyorkensis | 583 | ---VEELYQREPY---------ROSD-GKT----PIL-FRGVEQA------RKYGTEVIQRIEDASPEEK----VSKONLAEWE---R |
| 544240864 Leptotrichia wadei F0279 | 584 | ---DEKILSSKEAPY--------YAID-NKT----PIL-LSNFEKT------RKYGTQSFLSEIQSNYKYSK----VEKENIEDVNKKEEIEQK |
| 545623740 Leptotrichia wadei | 585 | ---DEKILSSKEAPY--------YAID-NKT----PIL-LSNFEKT------RKYGTQSFLSEIQSNYKYSK----VEKENIEDVNKKEEIEQK |
| 545623306 Leptotrichia wadei | 586 | ---NINQLNNFSE---------IFAD-GEN----VIK-HRSFVNI------KKVGILDLLEKIVD-KADIK----IKEEIKKYE---N |
| 506250229 Leptotrichia buccalis | 587 | ---KDRKELKKFDINK--------IVFD-GEN----IIK-HRAFYNI------KKVGMNLLEKIAD-KAKYK----ISTEELKKYS---N |
| Secondary structure for 506250229 (Jpred) | 588 | ---KDNKELKKFDINK--------IVFD-GEN----IIK-HRAFYNI------KKVGMNLLEKIAD-KAGYK----ISTKELKKYS---N |
| | | ---HHHH-----------E-------EEE----HHHH-------HHHHHHHHHHHHHH----HHHHHHHH |
| 545661797 Leptotrichia sp oral taxon 225 | 589 | ---KDNKELKKFDINK--------TYFD-GEN----IIK-HRAFYNI------KKYGMNLLEKISD-EAKYK----ISTEELKNYS---N |
| 545620493 Leptotrichia sp oral taxon 879 | 590 | ---EDTESENKNKEK--------TYYP-KEHANELYIYK-KNLFLNIGNPNEDIYGLISKDIKNWDTKILLD---DDIKK---N |
| 517267777 Leptotrichia shahii | 591 | ---EDMESENENKFQE-------TYYP-KERKANELYIYK-KNLFLNIGNPNFDIYGLISNDIKMADAKFLFN----IDGNIRK---N |
| CONSENSUS | | ............................D..................................YG...............I........ |
| HEPN (predicted RNAse) motifs | | |

FIG. 13M-2

| | SEQ ID NO: | | | |
|---|---|---|---|---|
| 564875111 Rhodobacter capsulatus R121 | 573 | EKSQIVAAA--QELRTDLHDKV--MK------------CHPKTISPEERQS----YAAAIKTEEHRFIVGRVYLGDHLRERIMMDVIGRLIDYAGAY |
| 769144435 Lachnospiraceae bacterium MA2020 | 574 | ------------KQEDLIRLY-----------------QIKGICS-------NKKEQQDLRTFQVLKNRVELRDIVEYSIINELYGQLIKNCYLR |
| 551041827 Lachnospiraceae bacterium NK4A179 | 575 | LKKETSQ-----------------------------YQTKGIFD----SEDEQKNIKKFQEMANIVERDLMDYSEIADELQGQLINWIYLR |
| 671463495 Clostridium aminophilum | 576 | LEKQIAP-----------------------------YRQNGYCK----SEEDQKLLRFQRIQNRVEQTITEFSIINELLGQLISNSFLR |
| Secondary Structure for 671463495 (Jpred) | | HHHHHHH---------------------------------------------HHHHHHHHHHHHH--HHHHHHHHHHHHHHHHGQLISNSYLR |
| 652829192 Lachnospiraceae bacterium NK4A144 | 577 | YLKKVSG-----------------------------YRVRGKCS----TEKEQEDILKFQRLKNAVERDVTEYAERVINELLGQLISNSYLR |
| 736546968 Carnobacterium gallinarum | 578 | KREEIGEL--VEKRKNLHTEW---AE----------GQQILGAEKREE-YRDYCKKIDRFNWKAAKVTILYSQLHYLITDLLGRMVGFSALF |
| 736550717 Carnobacterium gallinarum | 579 | EKEKIADL--VDKRTKLHEEN---ASKAREIEYNEKIKKNKSKKLDKPAEFAKFAEYKLICEAIENFNRLDHKVRITYLKNLHYSMIDMGRMVGFSVLF |
| 503209049 Paludibacter propionicigenes | 580 | AQKSIEQI--IKQBEDHHEQWVKARNADDKEKQERKREKSNFAQKFIEKHGDD--YLDICDVINTYNWLDNKMHFVILNRLHGLTIELLGRMAGVALF |
| 502750493 Listeria seeligeri | 581 | Y---DVTEK--IAQBSLHKQW---EK----------KPGLARDSAWTK--KYQNVINDISNYQWAKTKVELTQVRHHQLTIDLLSRLAGVMSIA |
| 738100542 Listeria weihenstephanensis | 582 | QKETIEEI--IERRKELHNEW---EK----------NPKKPQNNAFFK--EYKECCDAIDAYMQHAKTTLYVNEHHLLIELLGRYVGVAIA |
| 738133341 Listeria newyorkensis | 583 | QKETIEEI--IKRRKELHNEW---EK----------NPKKPQNNAFFK--BYKECCDAIDAYMQHAKTTLAVNEHHLLIELLGRYVGVAIA |
| 544240864 Leptotrichia wadei F0279 | 584 | KKSNIEKL--QDLKVELHKKW---------------EQNKITEKEIEK--YNNTITRKINEYNVLKNKEELQNVYLHEMLSDLLARNVAFFNKW |
| 738101039 Leptotrichia wadei | 585 | KKSNIEKL--QDLKVELHKKW---------------EQNKITEKEIEK--YNNTITRKINEYNVLKNKEELQNVYLHEMLSDLLARNVAFFNKW |
| 545623740 Leptotrichia wadei | 586 | LQNELKRNDFYKIQERIHRNY---NQKP--------FLINNEKDFND--YKKAIENIQNYTQLAKKIFNDLNLLQSLLFRILHRLVGYTSLW |
| 545623316 Leptotrichia buccalis | 587 | KKNEIEKN--YTMQQNLHRKY---ARPK--------KDEKFNDEDYKE--YEKAIGNIQKYTHLAKVEFNELNLLQCLLKLILHRLVGYTSIW |
| 506250229 Leptotrichia buccalis | 588 | KKNEIEKN--HRAQENLHRKY---ARPR--------KDEKFEDDEDYES--YKQAIENIEEYTHLAKVEFNELNLLQGLLLRILHRLVGYTSIW |
| Secondary structure for 506250229 (Jpred) | | HHHHHHH---HHHHHHHHHH-----H----------HHHHHH-------HHHHHHHHHHHHH--H------HHHHHHHHHHHHHHHHHH |
| 545661797 Leptotrichia sp oral taxon 225 | 589 | KKNEIEKN--HDNENLHRKY---ARPR--------KDEKFNDEDVKK---YEKAIRNIQQYTHLKKVEFNELNLLQSLLRILHRLVGYTSIW |
| 545621493 Leptotrichia sp oral taxon 879 | 590 | KISEIDAI--LRNLNDKLNGY--SNDYKAKVMKLKENDDFFAKNIQNENVSSFGEFEKDYNKVSEYKKIRDLVEFNYLNKIESYLIDINWKLAIQMARF |
| 517262777 Leptotrichia shahii | 591 | KISEIDAI--LRNLNDKLNGY--SRKYKEKVIKKIKKLKENDDFFAKNIQNKNVYS---EEKDYNKVSEYKKIRDLVEFNYVANKIESYLIDINWKLAIQMARF |
| CONSENSUS | | ..........I..................................................L..............................I.Y... |
| HEPN (predicted RNAse) motifs | | | | |

| | SEQ ID NO: | | |
|---|---|---|---|
| 564875111 Rhodobacter capsulatus R121 | 573 | ERDIGTFLIN-----ASKQIGAGADW------ | |
| 76914435 Lachnospiraceae bacterium MA2020 | 574 | ERDLMTFQLGFHYLCLANASSKEADYI---KLNVDDRNISGAIIVQIAAMVINGLPVYYKKDDMVYALKSGKKASDELNSNE------ | QTSKKINYFHKVGN |
| 551041827 Lachnospiraceae bacterium NK4A179 | 575 | ERDLMRFQLGYHYACLNNDSNKQATVYTLDYQCKKNRKINGAIIVQICAMVINGLPLYVDKDSEQTVSDGKE------ | STGAKIGEFYRAK |
| 671463495 Clostridium aminophilum | 576 | ERDLLVFQLGFHYLCLHNDTEKPAEVK---EISREDGTVIRNAILHQVAAMVVGGLPVVTLAD--KKLAAFEKGEADCKLSISKDTAGAGKKIKDFFRYSK | |
| Secondary Structure for 671463495 (Jpred) | | HHHHHHHHHHHHHH------EEEE----EEE----EE-HHHHHHHHHH------HHHH--HHHHE---EEE--- | H |
| 652829192 Lachnospiraceae bacterium NK4A144 | 577 | ERDLLVFQLGFHVMCLKNKSFKPAEVV---DIRRNNGTIIHNAILVQIVSMVINGLDFYSCDKEGKTLKPIETGK------ | GVGSKIGQFIKVSQ |
| 736546968 Carnobacterium gallinarum | 578 | ERDLLVFSRS--FSELGGETYHISDYKNLSGVLRLNAEVKPIKIKNIK------ | VIDNEENPYKGNEP |
| 736550717 Carnobacterium gallinarum | 579 | ERDFIVMGRS--YSALKKQSIYLNDY----DTPANIRDWEWNENKHLF------ | GISSSBLTFQETAE |
| 503209049 Paludibacter propionicigenes | 580 | DRDFQFFDEQ------QIADFKLHGFVNLHSIDKKLNEVPRKKIKELY------ | DIRNKIIQINGNKI |
| 502753493 Listeria seeligeri | 581 | DRDFQFSSNY--ILERENSLVRVTSWI-LLSENKNKNKYNDYELVNLK------ | NASIKVSSK--NDP |
| 738100542 Listeria weihenstephanensis | 582 | DRDFQCMANQ--YFKHSGITERVEVW------ | ---GDN |
| 738133341 Listeria newyorkensis | 583 | DRDFQCMANQ--YFKHSGITERVEVW------ | ---GDN |
| 544248864 Leptotrichia wadei F0279 | 584 | ERDFKIVIAIKQFLRENDEKVNEFLNPPDNSKGKKVFSVSKVK------ | NTVENIDGI--HKN |
| 738101039 Leptotrichia wadei | 585 | ERDFKIIVIAIKQFLRENDEKVNEFLNPPDNSKGKKVFSVSKVK------ | NTVENIDGI--HKN |
| 545623740 Leptotrichia wadei | 586 | ERDLQFKLKG--EYPENKYIDEIFNF-----DNSKNKIYNEKNERGG------ | SVVSKIGYFLWEKD |
| 545623306 Leptotrichia wadei | 587 | ERDLRFRLKG--EFPENHYIEEIFNF-----DNSKNVKYSG------ | QIVEKYINF--YKE |
| 506250229 Leptotrichia buccalis | 588 | ERDLRFRLKG--EFPENQYIEEIFNF-----BNKKNVKYRGG------ | QIVEKYIKF--YKE |
| Secondary structure for 506250229 (Jpred) | | H--HHHHHH---------HHHHHHHHH------ | ---HHHHHH--HHH |
| 545661797 Leptotrichia sp oral taxon 225 | 589 | ERDLRFRLKG--EFPENQYIEEIFNF-----NNSKNVKYNG------ | QIVEKYISF--YKE |
| 545621493 Leptotrichia sp oral taxon 879 | 590 | ERDMHYIVNG--IRELGIKLSGY-----NTGISRAYPKRNGSDGFY------ | TTTAYKFF--DEE |
| 517262777 Leptotrichia shahii | 591 | ERDMHYIVNG--IRELGIKLSGV-----NTGISRAYPKRNGSDGFY------ | TTTAYKFF--DEE |
| CONSENSUS | | ERD......... | |
| HEPN (predicted RNAse) motifs | | | |

FIG. 13N-1

| | SEQ ID NO: | | | | | |
|---|---|---|---|---|---|---|
| 564875111 Rhodobacter capsulatus R121 | 573 | ------- | MKDHL | ----- | IQDATIT-- | QAAIKHLDKV |
| 769144435 Lachnospiraceae bacterium MA2020 | 574 | FETGSKKVGRGDSEVIKPSAK | ----- | IRLRAANGVSSDVFTYKVG | ------- | RLTVGGPAAVWEARFSQ |
| 551041827 Lachnospiraceae bacterium NK4A179 | 575 | FVSGKKMIGIDKDRKIAEKECARTIREKNGIVSEQFTYKL | ----- | KNGTVY- | ----- | SKDELKIAT--LPAKNE |
| 671463495 Clostridium aminophilum | 576 | FPTGSKKVGEGKKITCKARAQ | ----- | IPIAENGMRSEDFTYKL | ------- | SDGKKNISTQMIAARDQ |
| Secondary Structure for 671463495 (Jpred) | | EE----E--- | HHEEE | ----- | EEE------- | ----- EEEE |
| 652829192 Lachnospiraceae bacterium NK4A144 | 577 | FGSGKKDVGIRDCK | -KERAQ | ----- | IEISEQSLTSEDFMFKLD | ------- DKAGEEAKK--FPARDE |
| 736546968 Carnobacterium gallinarum | 578 | ID------- | -ENHKN | ----- | FRIESLI--PKEIIH | ------- KDKAIK---TNQVSE |
| 736550717 Carnobacterium gallinarum | 579 | MN------ | -DHTKP | ----- | FRIESLK--PKKIIHLEK | ------- SNHSFP---MDQVSQ |
| 503209049 Paludibacter propionicigenes | 580 | L------- | -NADIK | ----- | IKVESLE--PKKIVHLGS | ------- SAKDPEVQYCTNQVMM |
| 502750493 Listeria seeligeri | 581 | PLY------ | -QTNHH | ----- | LKIDKLQ--PKKIHHLG | ------- EKSTVS---SNQVSN |
| 738100542 Listeria weihenstephanensis | 582 | NLK------ | -ENKHR | ----- | LVIKSLE--PKKLRHLGE | ------- KKIDNGYIE--TNQVSE |
| 738133341 Listeria newyorkensis | 583 | NLK------ | -ENKHR | ----- | LVIKSLE--PKKLRHLGG | ------- KKIDGGYIE--TNQVSE |
| 544240864 Leptotrichia wadei F0279 | 584 | ------- | -ISNDK | ----- | NEVFKYK--IKNRLY | ------- SKKGKM---LGKNNKFEILENEFLENVKAMLEYSE |
| 738101039 Leptotrichia wadei | 585 | ------- | -ISNDK | ----- | NEVFKYK--IKNRLY | ------- SKKGKM---LGKNNKFEILENEFLENVKAMLEYSE |
| 545623740 Leptotrichia wadei | 586 | ISHV----- | -NNSEK | ----- | IEVLNVD--SEKIKHL | ------- KANGLV---TTRNSE---DLCELIKMMLEYKKS |
| 545623306 Leptotrichia wadei | 587 | I------- | -GADKK | ----- | IEIQTLE--SEKIVHLKNL | ------- KKKKLM---TDRNSE---ELCELVKVMFEYKALE |
| 506250229 Leptotrichia buccalis | 588 | I------- | -GADKK | ----- | IGIQTLE--SEKIVHLKNL | ------- KKKKLM---TDRNSE---ELCKJVKIMFEYMEEKKSEN |
| Secondary structure for 506250229 (Jpred) | | E------- | ----E | ----- | EEEE------- | ----HHH------- HHHHH |
| 545661797 Leptotrichia sp oral taxon 225 | 589 | ------- | -EKDKK | ----- | IRIESLK--SEEVHLKKLKLKDNDKKKEPIK | ------- TYRNSK---ELCELVKVMFEYKMKEKKSEN |
| 545620493 Leptotrichia sp oral taxon 879 | 590 | ------- | -ELKKK | ----- | FRLIGNNDILERLMKPK | ------- KVSVLE---LESVNS---DYIKNLIIELLKIENTNDTL |
| 517262777 Leptotrichia shahii | 591 | ------- | -ELKKK | ----- | FKLIGNNDILERLMKPK | ------- KVSVLE---LESVNS---DYIKNLIIELLKIENTNDTL |
| CONSENSUS | | .............. | .............. | .............. | .............. | .............. |
| HEPN (predicted RNAse) motifs | | | | | | V..L....... |

| | DYLQMTAAVFNGSVQNPKPRRDDGD |
|---|---|
| | EFLLNVARLIYPDMEAVSENMVREG |
| | RVIQSTRLLFPEKVNMDEMIEVKE |
| | KYLNTVARLLYPHEAKSIV---- |
| | HHHHHHHHH---HH |
| | RVIQTAKLLYPNEIEDMNR---- |
| | EYCQSVLALLTNPGNQLN---- |
| | EYCDLVKKMLVPTN------- |
| | AVCNMCRSLLERKK------- |
| | EYCQLVRTLLITEK------- |
| | EYCGTVARLLIEI------- |
| | EYCGTVARLLIEM------- |
| | ELCELVKMLLEYKKS------- |
| | HHHHHHHHHHHHH |
| | ELCKLVKIMFEYMEEKKSEN---- |
| | DYIKNLIELLKIENTNDTL---- |
| | DYIKNHIELLKIENTNDTL---- |
| | .............. |

| Organism | SEQ ID NO: | Sequence |
|---|---|---|
| 564875111 Rhodobacter capsulatus R121 | 573 | AWHKPKPKPATAQSQPDQKPPNKAPSAGSRLPPQVGEVVYGVVVKVIDTGSLGHAVEGVAGNIGLHISRLRLRIREDAIIVGRRYRFFVEIYVPPKSNTS |
| 769144435 Lachnospiraceae bacterium MA2020 | 574 | VVKV----EKSNDKKGKISRGSNFRSSNQSKYNNKSNRMNYSMGS---- |
| 551041827 Lachnospiraceae bacterium NK4A179 | 575 | KKKP----SDNNTGKGYSKRDQDRKEYDKEKKKEGNFLSGMGGNT |
| 671463495 Clostridium aminophilum | 576 | --------DTRKKNNKKTNRGDGTTNKQGTARKEKDNGPREFNDTGFSNT |
| Secondary Structure for 671463495 (Jpred) | 577 | |
| 652829192 Lachnospiraceae bacterium NK4A144 | 578 | FMKKGETINKKVQFNRKKKITRKQKNNSSNEVLSS |
| 736546968 Carnobacterium gallinarum | 579 | |
| 736550717 Carnobacterium gallinarum | 580 | |
| 503209049 Paludibacter propionicigenes | 581 | |
| 502750493 Listeria seeligeri | 582 | |
| 738100542 Listeria weihenstephanensis | 583 | |
| 738133341 Listeria newyorkensis | 584 | |
| 544240864 Leptotrichia wadei F0279 | 585 | |
| 738101039 Leptotrichia wadei | 586 | |
| 545623740 Leptotrichia wadei | 587 | |
| 545623306 Leptotrichia wadei | 588 | |
| 506250229 Leptotrichia buccalis | 589 | |
| Secondary structure for 506250229 (Jpred) | 590 | |
| 545661797 Leptotrichia sp oral taxon 225 | 591 | |
| 545620493 Leptotrichia sp oral taxon 879 | | |
| 517262777 Leptotrichia shahii | | |
| CONSENSUS | | |
| HEPN (predicted RNAse) motifs | | |

| | SEQ ID NO: | |
|---|---|---|
| 564875111 Rhodobacter capsulatus R121 | 573 | KLNAADLVRID |
| 769144435 Lachnospiraceae bacterium MA2020 | 574 | IIEKMDLKFD- |
| 551041827 Lachnospiraceae bacterium NK4A179 | 575 | NWDEINAQLKN |
| 671463495 Clostridium aminophilum | 576 | PFAGFDPFRNS |
| Secondary Structure for 671463495 (Jpred) | | --------- |
| 652829192 Lachnospiraceae bacterium NK4A144 | 577 | TMGVLFKNIKL |
| 735546968 Carnobacterium gallinarum | 578 | --------- |
| 736550717 Carnobacterium gallinarum | 579 | --------- |
| 503209049 Paludibacter propionicigenes | 580 | --------- |
| 502750495 Listeria seeligeri | 581 | --------- |
| 738100542 Listeria weihenstephanensis | 582 | --------- |
| 738133341 Listeria newyorkensis | 583 | --------- |
| 544240864 Leptotrichia wadei F0279 | 584 | --------- |
| 738101039 Leptotrichia wadei | 585 | --------- |
| 545623740 Leptotrichia wadei | 586 | --------- |
| 545623306 Leptotrichia wadei | 587 | --------- |
| 506250229 Leptotrichia buccalis | 588 | --------- |
| Secondary structure for 506250229 (Jpred) | | |
| 545661797 Leptotrichia sp oral taxon 225 | 589 | |
| 545620493 Leptotrichia sp oral taxon 879 | 590 | |
| 517262777 Leptotrichia shahii | 591 | |
| CONSENSUS | | ......... |
| HEPN (predicted RNAse) motifs | | |

| | | SEQ ID NO: |
|---|---|---|
| 736550717\|Bacil\|Carnobacterium_gallinarum | -------IRANIAHLHVLRND | 1183 |
| 503209049\|Bacte\|Paludibacter_propionicigenes | -------IRNHIAHFNYLTKD | 1184 |
| 502750493\|Bacil\|Listeria_seeligeri | -------KRANISHFNYLNGQ | 1185 |
| 738100542\|Bacil\|Listeria_weihenstephanensis | -------ARNHIAHLNYLSLK | 1186 |
| 738133341\|Bacil\|Listeria_newyorkensis | -------ARNHIAHLNYLSLK | 1187 |
| 544240864\|Fusob\|Leptotrichia_wadei_F0279 | -------FRNYIAHFLHLHTK | 1188 |
| 545623740\|Fusob\|Leptotrichia_wadei | -------IRNYIAHFNYIPDA | 1189 |
| 545623306\|Fusob\|Leptotrichia_wadei | -------IRNYIAHFNYIPHA | 1190 |
| | | |
| 564875111\|Alpha\|Rhodobacter_capsulatus_R121 | -------TRKDLAHFNVLDRA | 1191 |
| 506250229\|Fusob\|Leptotrichia_buccalis | -------IRNYIAHFNYIPHA | 1192 |
| 545661797\|Fusob\|Leptotrichia_sp-_oral_taxon_225 | -------IRNYIAHFNYIPNA | 1193 |
| 545620493\|Fusob\|Leptotrichia_sp-_oral_taxon_879 | -------IRNYISHFYIVRNP | 1194 |
| 517262777\|Fusob\|Leptotrichia_shahii | -------IRNYISHFYIVRNP | 1195 |
| | -------HHHHHHH------- | |

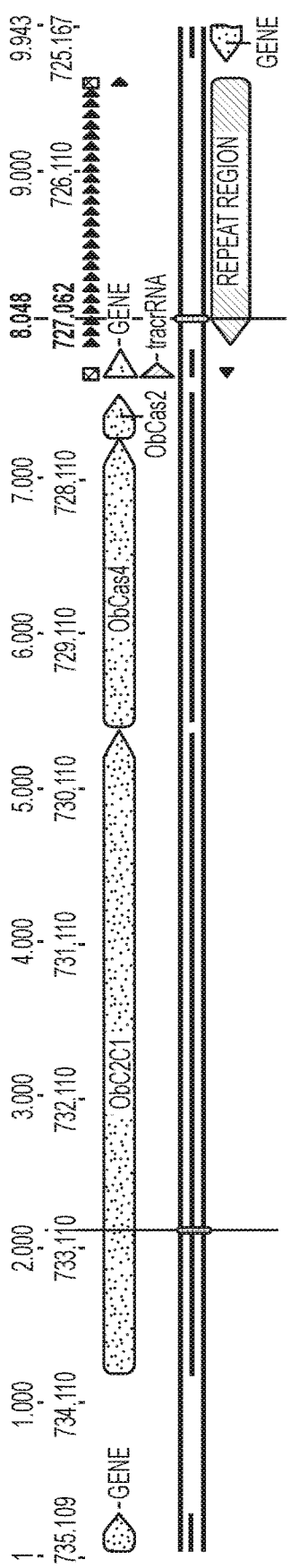
DR: GCCGCAGCGAAUGCCGUUUCACGAAUCGUCAGGCCGG    SEQ ID NO: 1204
tracrRNA:
GCUGGAGACGUUUUUGAAACGGGCGAGUGCGAGUCCUGCGGAUAGCGAGUUUCUCUUGGGGAGG
CGCUCGCGGCCACUUUU    SEQ ID NO: 1205
SEQ ID NO: 1206
SEQ ID NO: 1207
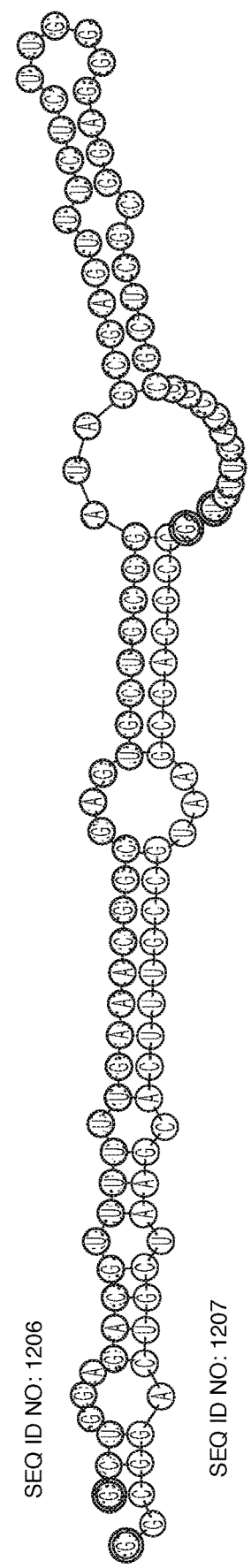
FIG. 19

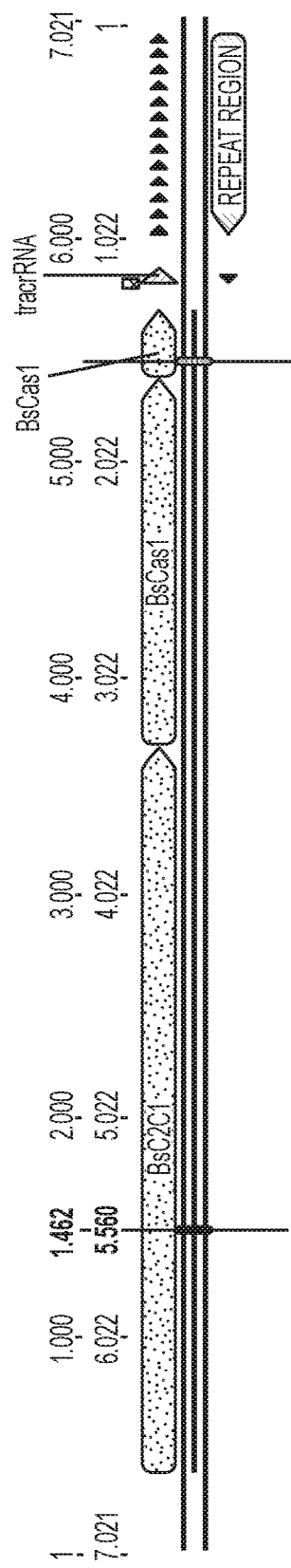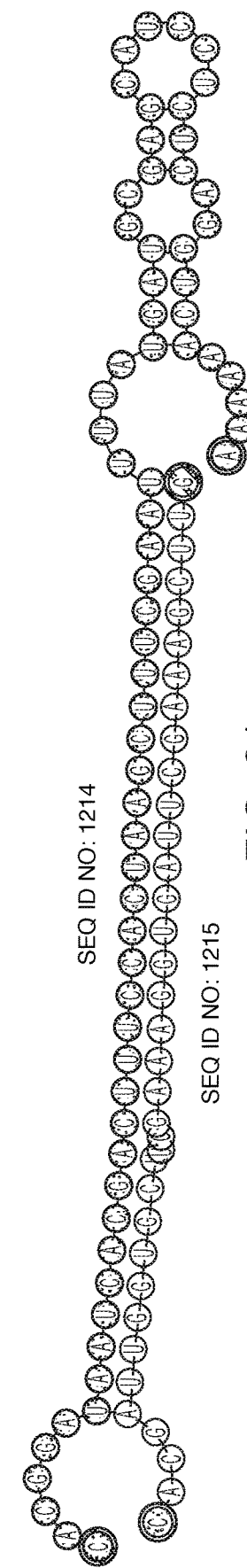
DR: GUUCGAAAGCUUAGUGGAAAGCUUCGUGGUUAGCAC  SEQ ID NO: 1212
tracrRNA:
CACGGAUAAUCACGACUUUCCACUAAGCUUUCGAAUUUUAUGAUGGCGAGCAUCCUCUC
AGGUCAAAAAA  SEQ ID NO: 1213
FIG. 21

DR: GUUUUAGACCUCUUCUAUUUUGAGGUACUCUAAAUC
tracrRNA: ???

SEQ ID NO: 1249

DR: GUUUUAGUCCUCUUUUGUUUUGAGGUACUCUAAAUC SEQ ID NO: 1250
tracrRNA:
AAGUCAGGCGCACAACAAGAAGAUGACGAACAAAAUCUCUGCCAUCUUCUUAAAAUU
AUUUGCCACACAGCCAACAUUAUAAGCGUUAAAAACCAGCACCAUGAGUACAUUUCACC
CAACAAUCAGAAUCCCCGUUUCUCCCGUUUUU

SEQ ID NO: 1251 orientation looks strange, but maybe system is different from type II

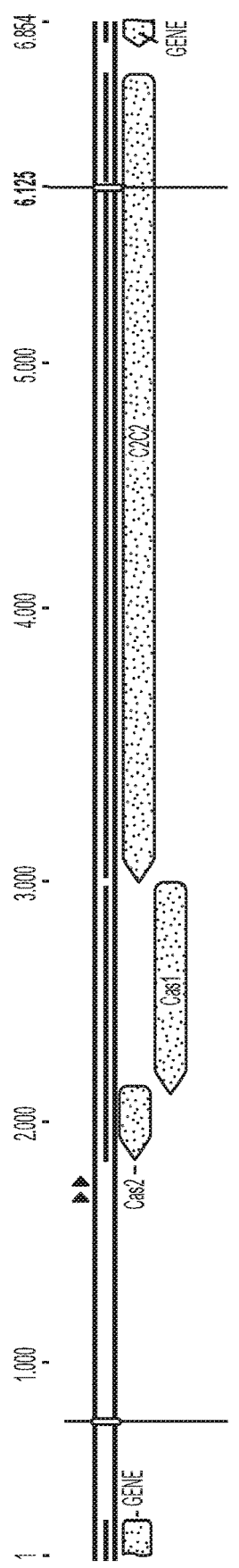

DR: GUUUUAGAUCCCUUCGUUUUGGGGUUAUCUAUAUC tracrRNA: ???

SEQ ID NO: 1254

FIG. 32

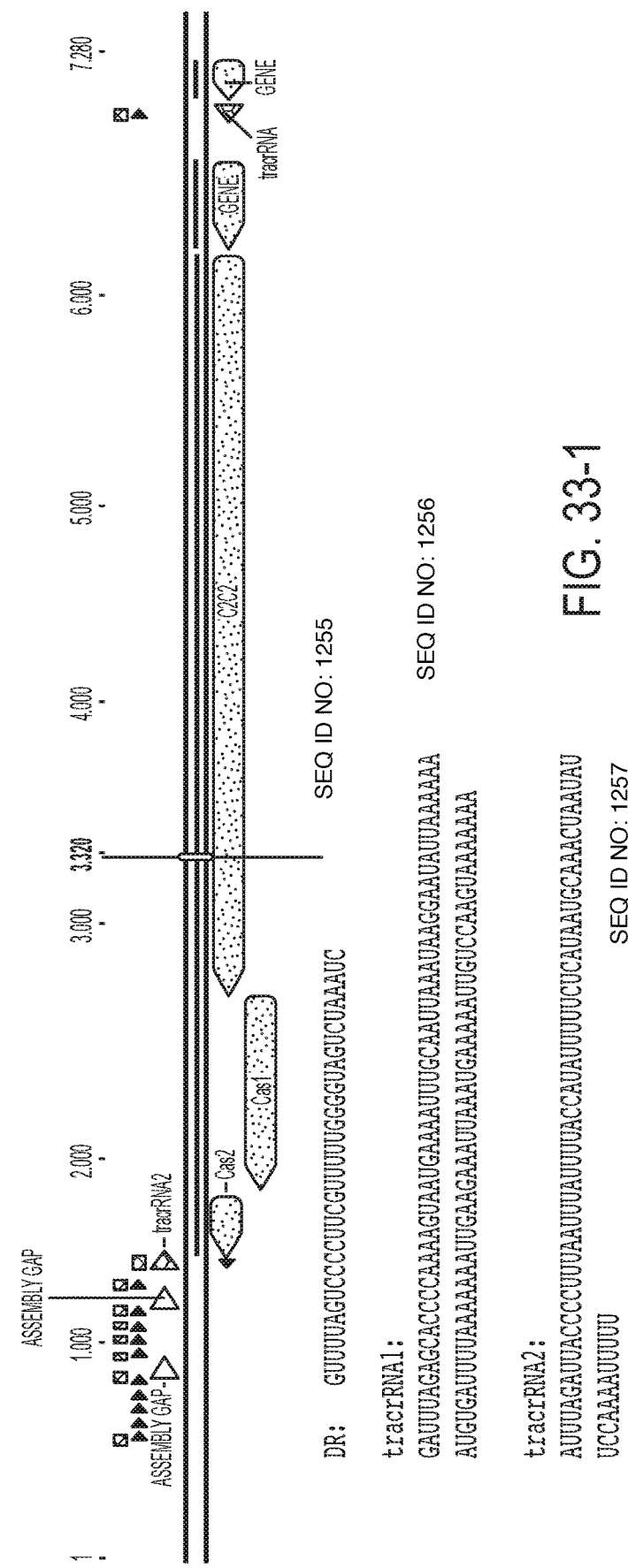

DR: GUUUUAGUCCCCUUCGUUUUGGGGUAGUCUAAAUC

SEQ ID NO: 1255 tracrRNA1:
GAUUUAGAGCACCCCAAAAGUAAAUGAAAAUUUGCAAUUAUAAGGAAUAUAUAAAAAA
AUGUGAUUUUAAAAAAAAUGAAGAAAUUAAAAUGAAAAAAUUGUCCAAGUAAAAAAA

SEQ ID NO: 1256 tracrRNA2:
AUUUAGAUUAACCCCUUUAAUUAUUAUUUACCAUAUUUAUUUUCUCAUAAUGCAAACUAUAU
UCCAAAAUUUUU

SEQ ID NO: 1257

FIG. 33-1

| Contig | Organism | Coordinates | Comment |
|---|---|---|---|
| 509144565 | candidate_division_KSB1_bacterium_SCGC_AAA252-P14 | 3828..7160 | No significant link to CRISPR |
| 393193621 | Methanofollis_liminatans_DSM_4140 | 32900..36433 | No significant link to CRISPR |
| 548699396 | Mastigocoleus_testarum_BC008 | 12241..14043 | No significant link to CRISPR |
| 523619502 | Alicyclobacillus_contaminans_DSM_17975 | 2..2656 | New type V-B |
| 529046751 | Alicyclobacillus_acidoterrestris_ATCC_49025 | 43576..46965 | New type V-B |
| 523618902 | Desulfovibrio_inopinatus_DSM_10711 | 18748..22197 | New type V-B |
| 752260228 | Bacillus_thermoamylovorans | 13317..16443 | New type V-B |
| 752646821 | Bacillus_thermoamylovorans | 13317..16443 | New type V-B |
| 523610094 | Tuberibacillus_calidus_DSM_17572 | 2578..5976 | New type V-B |
| 545659012 | Bacillus_sp._NSP2.1 | 258813..261939 | New type V-B |
| 398052704 | Brevibacillus_sp._CF112 | 10972..13566 | New type V-B |
| 356694950 | Johnsonella_ignava_ATCC_51276 | 200042..202360 | No significant link to CRISPR |
| 658749509 | [Clostridium]_aminophilum_DSM_10710 | 4296..6053 | Related to new type VI |
| 607833270 | Nitrosomonas_cryotolerans_ATCC_49181 | 6131..8125 | No significant link to CRISPR |
| 574656975 | Aphanizomenon_flos-aquae_NIES-81 | 18206..20065 | No significant link to CRISPR |
| 635279000 | Methanoculleus_sp._MH98A | 101187..104750 | Too few representatives |
| 602260317 | Prevotella_nanceiensis_DSM_19126 | 210031..214008 | No significant link to CRISPR |
| 481788270 | Prevotella_nanceiensis_DSM_19126 | 377111..381088 | No significant link to CRISPR |
| 324989223 | Prevotella_multiformis_DSM_16608 | 13459..15066 | No significant link to CRISPR |
| 544235488 | Leptotrichia_wadei_F0279 | 1390..4848 | New type VI |
| 544234856 | Leptotrichia_wadei_F0279 | 6397..9990 | New type VI |
| 315250649 | Prevotella_buccae_ATCC_33574 | 14913..15442 | No significant link to CRISPR |
| 544240836 | Leptotrichia_wadei_F0279 | 26119..29661 | New type VI |

FIG. 40A

| | | | |
|---|---|---|---|
| 544243142 | Leptotrichia_sp_oral_taxon_879_str_F0557 | 1427.5584 | New type VI |
| 480981602 | Leptotrichia_shahii_DSM_19757 | 35756.39925 | New type VI |
| 389663695 | Nitritalea_halalkaliphila_LW7 | 284.1873 | No significant link to CRISPR |
| 570981644 | Salinispora_arenicola_CNB458 | 2316.4646 | No significant link to CRISPR |
| 570981644 | Salinispora_arenicola_CNB458 | 2316.4646 | No significant link to CRISPR |
| 481710649 | Henriciella_marina_DSM_19595 | 2829736..2833695 | No significant link to CRISPR |
| 330406018 | Lachnospiraceae_bacterium_9_1_43BFAA | 183589..185739 | No significant link to CRISPR |
| 675284423 | Edaphobacter_aggregans_DSM_19364 | 355.2904 | No significant link to CRISPR |
| 675284558 | Lachnospiraceae_bacterium_MA2020 | 90805..94827 | New type VI |
| 571166608 | Klebsiella_pneumoniae_iS39 | 3264.4844 | No link to CRISPR in another species |
| 747197290 | Klebsiella_pneumoniae | 1273.3294 | No link to CRISPR in another species |
| AUX014641567.1 | Gut metagenome contig-19000410, whole genome shotgun sequence | 135.4229 | New type VI |
| AUX011669375.1 | Gut metagenome contig-12145000233, whole genome shotgun sequence | 6252.9371 | New type VI |
| AUX011669375.1 | Gut metagenome contig-12145000233, whole genome shotgun sequence | 25381.29659 | New type VI |
| AUX011277409.1 | Gut metagenome contig-13905000209, whole genome shotgun sequence | 2011.6000 | New type VI |
| AUX014986615.1 | Gut metagenome contig-27000430, whole genome shotgun sequence | 2675.5857 | New type V-B |
| JXQJ01000001.1 | Gut metagenome contig-2000186, whole genome shotgun sequence | 2246.4072 | Related to new type VI |
| AUX015635074.1 | Methanoculleus sp. S3Fa_S3Fa_contig_1, whole genome shotgun sequence | 551839..555405 | Associated with another (non casposon) branch of stand alone cas1 in Methanomicrobiales |
| AUX016086082.1 | Gut metagenome contig-990000468, whole genome shotgun sequence | 1..1731t | cas9 |
| APM01010458.1 | Gut metagenome contig-82000495, whole genome shotgun sequence | 1661.3220 | cas9 |
| | Wastewater metagenome HPminus7502.1, whole genome shotgun sequence | 14552..16243 | cas9 |

FIG. 40B

| Accession | Description | Value | Note |
|---|---|---|---|
| JRHI01002292.1 | Sediment metagenome Contig_4549, whole genome shotgun sequence | 2735.5587 | No link to CRISPR in another species |
| CEOS01145029.1 | marine metagenome genome assembly TARA_056_MES_0.22-3_scaffold278047_1, whole genome shotgun sequence | 428.3727 | No link to CRISPR in another species |
| CETS01072683.1 | marine metagenome genome assembly TARA_122_MES_0.22-3_scaffold170685_1, whole genome shotgun sequence | 4286.7009 | DNA polymerase, no link to CRISPR |
| CERQ01119696.1 | marine metagenome genome assembly TARA_065_MES_0.22-3_scaffold243316_1, whole genome shotgun sequence | 656.2476 | cas9 |
| CENJ01173765.1 | marine metagenome genome assembly TARA_009_SRF_0.22-1.6_scaffold289219_1, whole genome shotgun sequence | 2.1636 | No link to CRISPR in another species |
| AUXO18285776.1 | Gut metagenome contig-138000062, whole genome shotgun sequence | 1.1743 | cas9 |
| AUXO13399408.1 | Gut metagenome contig-6000335, whole genome shotgun sequence | 2472.6140 | New type V-C |
| CEPS01188136.1 | marine metagenome genome assembly TARA_038_MES_0.22-1.6_C8568097_1, whole genome shotgun sequence | 184.3993 | New type V-C |
| CEPV01213247.1 | marine metagenome genome assembly TARA_039_MES_0.22-1.6_C8247301_1, whole genome shotgun sequence | 1.3567 | New type V-C |
| CEQE01148443.1 | marine metagenome genome assembly TARA_037_MES_0.22-1.6_scaffold260484_1, whole genome shotgun sequence | 140.3907 | New type V-C |
| CABS01000008.1 | Carnoules arsenic-contaminated mine drainage metagenome, Contig1018, whole genome shotgun sequence | 2.1981 | No link to CRISPR in another species |
| ADK101000125.1 | Hot springs metagenome ctg_110644518O528, whole genome shotgun sequence | 3.1790 | No link to CRISPR in another species |
| AMWB02169112.1 | Bioreactor metagenome contig_98797, whole genome shotgun sequence | 1140.3248 | No link to CRISPR in another species |
| CETS01005188.1 | marine metagenome genome assembly TARA_122_MES_0.22-3_scaffoid13234_1, whole genome shotgun sequence | 4650.6296 | No link to CRISPR in another species |
| CEQG01121408.1 | marine metagenome genome assembly TARA_076_MES_0.45-0.8_scaffold243523_1, whole genome shotgun sequence | 2041.3687 | No link to CRISPR in another species |

FIG. 40C

| Accession | Description | Value | Note |
|---|---|---|---|
| CEOS01016354.1 | marine metagenome genome assembly TARA_056_MES_0.22-3_contig TARA_056_MES_0.22-3_scaffold444429_2, whole genome shotgun sequence | 9636.11282 | No link to CRISPR in another species |
| CEQG01121408.1 | marine metagenome genome assembly TARA_076_MES_0.45-0.8_contig TARA_076_MES_0.45-0.8_scaffold243523_1, whole genome shotgun sequence | 332.2044 | No link to CRISPR in another species |

| No | LOCUS STRUCTURE* | SPECIES NAME AND LINK TO NCBI GENOME VIEWER |
|---|---|---|
| 1 | <unk><casCandidate>><cas1><cas4cas1>>[T]>CRISPR1[D] | Alicyclobacillus acidoterrestris ATCC 49025 contig_26, whole genome shotgun sequence http://www.ncbi.nlm.nih.gov/projects/sviewer/?id=NZ_AURB01000127.1&v=42000:51000 |
| 2 | >casCandidate>>cas4cas1>>cas2> | Alicyclobacillus contaminans DSM 17975 G463DRAFT_scaffold00017.17, whole genome shotgun sequence http://www.ncbi.nlm.nih.gov/projects/sviewer/?id=NZ_KE386913.1&v=1:8000 |
| 3 | >casCandidate>>cas4cas1>>cas2> | Desulfovibrio inopinatus DSM 10711 G451DRAFT_scaffold00007.7, whole genome shotgun sequence http://www.ncbi.nlm.nih.gov/projects/sviewer/?id=NZ_KE386879.1&v=244012:257461 |
| 4 | toxin>-antitoxin>->DNABindingProtein>>casCandidate>>CRISPR1[D] | Desulfonatronum thiodismutans strain MLF-1 contig6, whole genome shotgun sequence http://www.ncbi.nlm.nih.gov/projects/sviewer/?id=NZ_JPIK01000006.1&v=80000:92000 |
| 5 | [D]CRISPR1-<[T]<<HelTurnHel<<cas2<<cas1cas4<<casCandidate | Opitutaceae bacterium TAV5, complete genome http://www.ncbi.nlm.nih.gov/projects/sviewer/?id=NZ_CP007053.1&v=72757:737923 |
| 6 | <cas2<<casCandidate<<cas1cas4<<casCandidate<<Transposase<<casCandidate | Tuberibacillus calidus DSM 17572 H532DRAFT_scaffold00011.11, whole genome shotgun sequence http://www.ncbi.nlm.nih.gov/projects/sviewer/?id=NZ_KE387796.1&v=29000:41000 |
| 7 | >casCandidate>>cas4cas1>>cas2>>[T]>CRISPR1[D] | Bacillus thermoamylovorans strain B4166 NODE_401, whole genome shotgun sequence http://www.ncbi.nlm.nih.gov/projects/sviewer/?id=NZ_JXLT01000152.1&v=1000:23000 |
| 8 | >casCandidate>>cas4cas1>>cas2> | Brevibacillus sp. CF112 PMI08_contig_61.61, whole genome shotgun sequence http://www.ncbi.nlm.nih.gov/projects/sviewer/?id=NZ_AKKB01000053.1&v=10000:16000 |
| 9 | CRISPR1-<[T]<cas2<<cas4cas1<<casCandidate-[D]CRISPR2-<unk-unk<-[D]CRISPR3 | Bacillus sp. NSP2.1 scaffold00005, whole genome shotgun sequence http://www.ncbi.nlm.nih.gov/projects/sviewer/?id=NZ_KI301973.1&v=310311:325637 |
| WEAK | | |
| 10 | ABC Transp>-[D]CRISPR1-<unk-<casCandidate< | Desulfatirhabdium butyrativorans DSM 18734 G499DRAFT_scaffold00017.17, whole genome http://www.ncbi.nlm.nih.gov/projects/sviewer/?id=NZ_KE386988.1&v=26000:38000 |
| 11 | >casCandidate> | Alicyclobacillus herbarius DSM 13609 H522DRAFT_scaffold00043.43_C, whole genome shotgun sequence http://www.ncbi.nlm.nih.gov/projects/sviewer/?id=NZ_AUMH01000044.1&v=1200:4200 |
| 12 | >casCandidate> | Alicyclobacillus contaminans DSM 17975 G463DRAFT_scaffold00075.75_C, whole genome shotgun sequence http://www.ncbi.nlm.nih.gov/projects/sviewer/?id=NZ_AUCA01000076.1&v=5999:6832 |
| 13 | <casCandidate< | Citrobacter freundii ATCC 8090 = MTCC 1658 contig125, whole genome shotgun sequence http://www.ncbi.nlm.nih.gov/projects/sviewer/?id=41770297 |
| 14 | <casCandidate< | Citrobacter freundii ATCC 8090 = MTCC 1658 contig125, whole genome shotgun sequence http://www.ncbi.nlm.nih.gov/projects/sviewer/?id=421848214 |
| 15,16 | CRISPR1-<cas2<<unk<-casCandidate(split)<-[D]CRISPR2 | Brevibacillus agri BAB2500 contig150, whole genome shotgun sequence |

| | | |
|---|---|---|
| 17 | SOS>>unk><casCandidate<-[D]CRISPR1 | http://www.ncbi.nlm.nih.gov/projects/sviewer/?id=NZ_AOBR01000150.1&v=1:10000<br>Brevibacillus sp. CF112 PMI08_contig_212.212, whole genome shotgun sequence<br>http://www.ncbi.nlm.nih.gov/projects/sviewer/?id=NZ_AKKB01000158.1&v=21000:26000 |
| 18 | <Peptidase<-[D]CRISPR1-<casCandidate<-<unk< | Methylobacterium nodulans ORS 2060, complete genome<br>http://www.ncbi.nlm.nih.gov/projects/sviewer/?id=NC_011894.1&v=620239:630215 |

FIG. 41B

1: *Alicyclobacillus acidoterrestris* ATCC 49025 contig_26, whole genome shotgun sequence SEQ ID NOs: 1272-1278

| Repeat | %id | Spacer | Left flank | Repeat | Spacer |
|---|---|---|---|---|---|
| 36 | 100.0 | 35 | AGCGCCCGCT | ............................ | TGTTTGGTAAAGGTAAAAAGACGAATGATGCATCC |
| 36 | 100.0 | 37 | TGATGCATCC | ............................ | CCTTTATAAAAAGGGGCGTCCTTTAGTACCGTGTACT |
| 36 | 100.0 | 38 | ACCGTGTACT | ............................ | AAGCCTTGAGTAATTCGCCGTGGGATTCCCCGCCGTAT |
| 36 | 100.0 | 34 | CCCGCCGTAT | ............................ | TAATGAAGTTAAAGGAGATGAGACAATGAAAGAA |
| 36 | 100.0 | 37 | AATGAAAGAA | ............................ | TGCAATGCGTTGGATTATGACGATGCAGGCCAAGGAA |
| 36 | 100.0 |    | GGCCAAGGAA | ............................ | TGATGTCAGC |

36  36  GTCGGATCACTGAGCGAGCGATCTGAGAAGTGGCAC dG = -2.93   dH = -44.70   dS = -134.68   $T_m$ = 58.8 °C

2229

```
                          10
   GT --------      |   A    GA
                  CGGATC  CT      \
                  GTCTAG  GA   G
      CACGGTGAAGA^    C    GC
            30              20
```

4: *Desulfonatronum thiodismutans* strain MLF-1 contig6, whole genome shotgun sequence SEQ ID NOs: 1280-1284

| Repeat | %id | Spacer | Left flank | Repeat | Spacer |
|---|---|---|---|---|---|
| 37 | 100.0 | 37 | CCGGCTCGAG | ............................ | ATCCAGGTGGTTGGATGCGGGACATACCTTCCGCCTT |
| 37 | 100.0 | 37 | CTTCCGCCTT | ............................ | TGCTTCCCGGCGAACGGCGAGCTGACCTCCTAGATGT |
| 37 | 100.0 | 36 | TCCTAGATGT | ............................ | CGTCTGCTCGGTCTCCGGACTTCACCACCACGTCCAC |
| 37 | 100.0 |    | CCACGTCCAC | ............................ | GGGTGCGGCATTTGCGGGTGTTGGGGGAGTGGCAGG |

37  36  GTCTCGGCAAGCTTGGTCAGTGTTGGGTGATTGGCAC dG = -0.96   dH = -46.70   dS = -147.48   $T_m$ = 43.5 °C

2230

```
                    10
    . -GTCTCGG|  A
                  CA   G
                  GT    C
  \  ------    ^   T 20           30
    GTCAGTGTTGG      AT
                  GTG      \
                  CAC    T
    -------------      GG
                       GG
```

5: *Opitutaceae* bacterium TAV5, complete genome

SEQ ID NOs: 1287-1311

| Repeat | %id | Spacer | Left flank | Repeat | Spacer |
|---|---|---|---|---|---|
| 36 | 100.0 | 34 | ACATCCACTG | ............................ | AATAGTCTCTGGAAATGTTATAGTAGCTCCTACA |
| 36 | 100.0 | 35 | AGCTCCTACA | ............................ | AAGCAAAAAGAGTCGTGGTGTTGGCGCGGGTCAGAC |
| 36 | 100.0 | 34 | CGGGTCAGAC | ............................ | AATGTAACGCCTGGAGCATGGCTTGACCCGAACC |
| 36 | 100.0 | 36 | GACCCGAACC | ............................ | AATATACGTCTGATTAAAGGTATGGGGATTCCCTGTT |
| 36 | 100.0 | 34 | ATTCCCTGTT | ............................ | TCTCAGTCAATTCGAATATGATGCGGGGTACTGG |
| 36 | 100.0 | 34 | GGGGTACTGG | ............................ | GCTCCACAAAAGCGATTATCATTTCCCGGTTATA |
| 36 | 100.0 | 36 | CCCGGTTATA | ............................ | GTGCCCGGCCATGCGGTTATCGGTCTCGATGGCCTT |
| 36 | 100.0 | 33 | CGATGGCCTT | ............................ | TCGCGGGGAAACGAGTGCGTAGTCGATCGTCAC |
| 36 | 100.0 | 33 | CGATCGTCAC | ............................ | GTAGCTGTCGCCCGTCTTTCTTGTATTCTTTTTT |
| 36 | 100.0 | 36 | ATTCTTTTTT | ............................ | GATCGGACAATCACGCCAGACATTGCCGGTCATGAT |
| 36 | 100.0 | 37 | CGGTCATGAT | ............................ | TTGGCGACCTTCAGCCGAGCGTTATTGGCGGCATAGA |
| 36 | 100.0 | 35 | GCGGCATAGA | ............................ | AAAAATGGCGAAACCGAAGCCGCCGACGCGATACA |
| 36 | 100.0 | 34 | ACGCGATACA | ............................ | ATGTCAATTTTGGTAACACTTCGCCTTGGCACCA |
| 36 | 100.0 | 34 | CTTGGCACCA | ............................ | ATGTCAATTTTGGTAACACTTCGCCTTGGCACCA |
| 36 | 100.0 | 34 | CTTGGCACCA | ............................ | AGCACGTGGGGTTTTTGCTCTCACAAAGTAAATT |
| 36 | 100.0 | 33 | AAAGTAAATT | ............................ | ATAGCATCGGCGAGTGTGTCTGACAGTCCTACT |
| 36 | 100.0 | 37 | CAGTCCTACT | ............................ | GGCGAACCCTCGTCAACCGCGACCTCAAGATGGCACA |
| 36 | 100.0 | 35 | AGATGGCACA | ............................ | AACGCATCACGCGCCTCCGGCTCCATTTCCTTGCC |
| 36 | 100.0 | 34 | TTTCCTTGCC | ............................ | TCCGCTCACAGGGCAATCTACGCTCAGGAGATG |
| 36 | 100.0 | 35 | TCAGGAGATG | ............................ | GAAAACGCCCCGAAACACAGCTTCCCGAATTCAAAT |
| 36 | 100.0 | 33 | GAATTCAAAT | ............................ | AGCACAATTCCGAGAAACGTTTCAGGATCATA |
| 36 | 100.0 | 35 | CAGGATCATA | ............................ | GCCAGCGTTCCCTGCGATGCTGTTGCGAAATCCCC |
| 36 | 100.0 | 34 | CGAAATCCCC | ............................ | TTGCACTGCTGGTGAAAGAGTTCAAAGCGTCCA |
| 36 | 100.0 |    | AAAGCGTCCA | ............................ | CCGTGCTCGC |

36  34  CCGCCTGACGATTCGTGAAACGGCATTCGCTGCGGC

FIG. 41C $dG = -3.91$  $dH = -76.50$  $dS = -234.05$  $T_m = 53.7$ °C
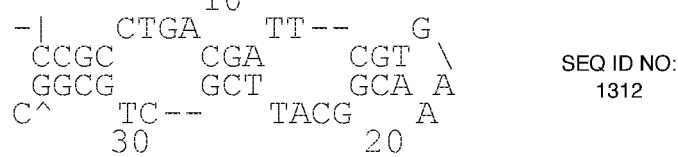
SEQ ID NO: 1312
$dG = -3.65$  $dH = -66.00$  $dS = -201.03$  $T_m = 55.2$ °C
SEQ ID NO: 1313
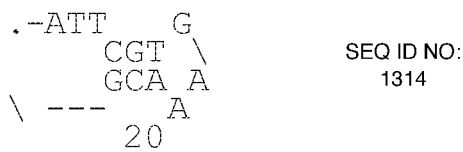
SEQ ID NO: 1314
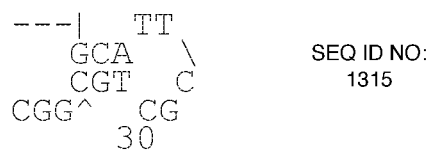
SEQ ID NO: 1315
$dG = -3.37$  $dH = -65.30$  $dS = -199.68$  $T_m = 53.9$ °C
SEQ ID NO: 1316
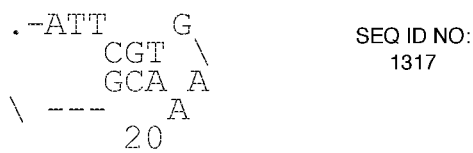
SEQ ID NO: 1317
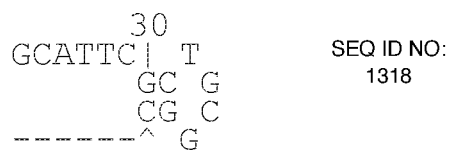
SEQ ID NO: 1318
$dG = -3.21$  $dH = -67.60$  $dS = -207.61$  $T_m = 52.5$ °C
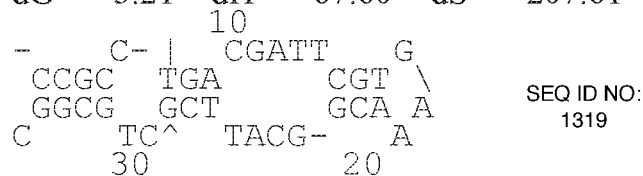
SEQ ID NO: 1319
FIG. 41D dG = -3.08   dH = -64.10   dS = -196.74   Tm= 52.7 °C
SEQ ID NO: 1320
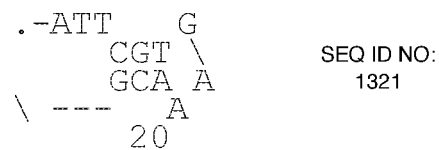
SEQ ID NO: 1321
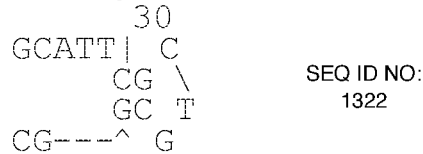
SEQ ID NO: 1322
dG = -3.04   dH = -56.00   dS = -170.76   Tm= 54.8 °C
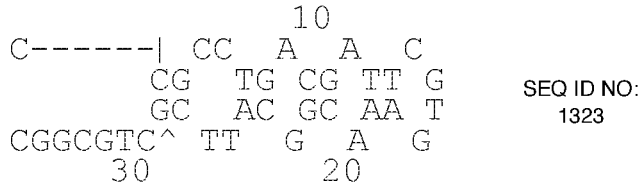
SEQ ID NO: 1323
dG = -3.01   dH = -58.70   dS = -179.56   Tm= 53.8 °C
SEQ ID NO: 1324
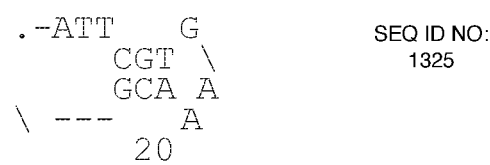
SEQ ID NO: 1325
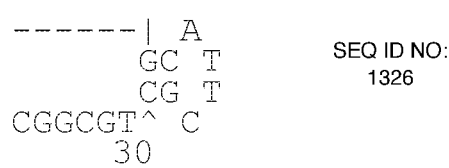
SEQ ID NO: 1326
FIG. 41E 7: Bacillus thermoamylovorans strain B4166 NODE_401, whole genome shotgun sequence

| Repeat | %id | Spacer | Left flank | Repeat | Spacer |
|---|---|---|---|---|---|
| 36 | 100.0 | 35 | ACCCCCTGCG | ................................. | CATGCAAACGGATTGTTATATAAATCTTCTTGAAC |
| 36 | 100.0 | 36 | CTTCTTGAAC | ................................. | ATTGTTCCGGCGGCTAATTTGTCTGCGGTAATCGAA |
| 36 | 100.0 | 41 | GGTAATCGAA | ................................. | CTTCGCCATCCTCATCCCTTATCAGTTGATTGCCTAGCGTT |
| 36 | 100.0 | 37 | GCCTAGCGTT | ................................. | ACACAGAAACCAAATGGGAACACGTTTTCGTTAATAA |
| 36 | 100.0 | 38 | TCGTTAATAA | ................................. | GACATTAAAAAATTCCAACCAAGCGAGTTATTGAGTGG |
| 36 | 100.0 | 34 | TATTGAGTGG | ................................. | TTATGAGCTTAAAAGCTTGTTAGCGACATTAAAC |
| 36 | 100.0 | 37 | GACATTAAAC | ................................. | GTTTTGTTACAGCTTTATTCCTTACTTGATCGACTCT |
| 36 | 100.0 | 37 | GATCGACTCT | ................................. | CAGAACCTATCTCAAGAGGATGCATTCTGGAAAGGAA |
| 36 | 100.0 | 40 | TGGAAAGGAA | ................................. | CTTATAACAATAATTTAAAAGCAATTTATGACTGTATAGA |
| 36 | 100.0 | 36 | ACTGTATAGA | ................................. | TTTTAAGGGACATCAGAAACACTATAAGCTCACTTG |
| 36 | 100.0 | 35 | AGCTCACTTG | ................................. | ATAATCGACTTTGCATTTCTATACTGTCGTTCATC |
| 36 | 100.0 | 39 | GTCGTTCATC | ................................. | AAAATGGAACAAGGAACAATAGACGTTTATAAGTATGGA |
| 36 | 100.0 | 37 | TAAGTATGGA | ................................. | TTTCAATAAAGCATCAAACTCTTTTTTGCATTTTTTCA |
| 36 | 100.0 | 37 | CATTTTTTCA | ................................. | ACCGAGTAAGGAATCGTTTAATCAACAAACTTGAAAC |
| 36 | 100.0 | 38 | AACTTGAAAC | ................................. | GGTAGTCGGCGGGTAAGTGTCGCAGGGTTAACACCGAT |
| 36 | 100.0 | 39 | TAACACCGAT | ................................. | ACGCTGAACAAAACTCACGAAACCAAAAGTTTATAAAAT |
| 36 | 100.0 | 35 | TTTATAAAAT | ................................. | GGAAAGGATTTACTAGATCTCGCAAGAAAGGTAAC |
| 36 | 100.0 | 36 | GAAAGGTAAC | ................................. | ATTTAGTATATTGTTGTTTTCATTTGCTTTTTTTCGC |
| 36 | 100.0 | 37 | CTTTTTTCGC | ................................. | TTATACCGTAAAAAATTTTGGATTTGATGTCACCGTC |
| 36 | 100.0 | 36 | TGTCACCGTC | ................................. | AGAACACAAAAGCGGAAAAATTGCACTTATTTTCG |
| 36 | 100.0 | 36 | CTTATTTTCG | ................................. | AATACTCGTCTACAAACTTTTTCTGCTTTTCTGTTA |
| 36 | 100.0 | 38 | TTTTCTGTTA | ................................. | CATACAGGACACTTAAACTCTACTTTACGATTTTCAAA |
| 36 | 97.2 | 36 | GATTTTCAAA | .......................T......... | GATTTAAAACTTCTTCTGGCATCCAGTACATAGATT |
| 36 | 97.2 | 36 | TACATAGATT | .......................T......... | GAAAAACTGTTTCCTTATCACACCTATAGCAATAA |
| 36 | 97.2 | 38 | ATAGCAATAA | .......................T......... | TCTAGATATGTTCAAGAAAATATGCAGTCTATCGGTCA |
| 36 | 97.2 | 39 | CTATCGGTCA | .......................T......... | GAATCAATTAATCCAATTTGTTGCAACTTAGGTAGAGAG |
| 36 | 97.2 | 38 | AGGTAGAGAG | .......................T......... | CCGAATTAGCATCGTACCAATTACATCCATATGATGCT |
| 36 | 97.2 | 36 | ATATGATGCT | .......................T......... | TTTTCTATTTTTATATTACTGTTTGTTTGGTGATAA |
| 36 | 97.2 | 38 | TTGGTGATAA | .......................T......... | TGAATCTAACCAAGGAAGAAATAAAAGATATTTATAAG |
| 36 | 97.2 | 35 | TATTTATAAG | .......................T......... | AAAAAGGAGTGTTTCAAAATGCAAATGAAAAAAG |
| 36 | 97.2 | 36 | ATGAAAAAAG | .......................T......... | AGCTTGGATTGAATCAAACAATGGTGGTCGAGGTTT |
| 36 | 97.2 | 36 | GTCGAGGTTT | .......................T......... | TTGAGTTGTAATTAATCACCGTTGTCTACCTGAAAACT |
| 36 | 97.2 | 34 | CCTGAAAACT | .......................T......... | TAGATGTTGAAAACGGCGGTTTTGTCTATTATCC |
| 36 | 97.2 | 38 | TCTATTATCC | .......................T......... | AAACCCGCAAAAATAAGCTGTTGACGAGTCTAGTTAG |
| 36 | 100.0 | 39 | GTCTAGTTAG | ................................. | TTGTCAATCCTCGAAATGCCGGGCGGACGGGCTTGCCA |
| 36 | 97.2 | 35 | GGGCTTGCCA | ................A................ | CCACCACCGACGGCGTCCACGCCCAATTGCCTGCTT |
| 36 | 100.0 | 26 | TTGCCTGCTT | ................................. | AACAATATAAACGACTACTTTACCGT |
| 36 | 94.4 | | ACTTTTACCGT | ..T......................T........ | GATGGGATGG |

| 36 | | 36 | | SEQ ID NO: 1365 | GTCCAAGAAAAAAGAAATGATACGAGGCATTAGCAC | dG = -1.12   dH = -22.40   dS = -68.61   T_m = 53.3 °C

```
             10          20         30
GTCCAAGAAAAAAGAAATGATACGAG | A
                           GC  T        SEQ ID NO: 1366
                           CG  T
CA-------------------------^ A
``` dG = -0.77   dH = -25.50   dS = -79.74   T_m = 46.7 °C

```
             10          20
GTCCAAGAAAAAAGA |    ATA
                AATG    C              SEQ ID NO: 1367
                TTAC    G
CACGA----------^    GGA
              30
```

FIG. 41F

*9: Bacillus sp. NSP2.1 scaffold00005, whole genome shotgun sequence*
Array 1
>gi|651512587|ref|NZ_KI301973.1|:310311-325637 Bacillus sp. NSP2.1 scaffold00005, whole genome shotgun sequence SEQ ID NOs: 1368-1380

| Repeat | %id | Spacer | Left flank | Repeat | Spacer |
|---|---|---|---|---|---|
| 36 | 100.0 | 37 | GGACTTTAGC | .................................... | ACCCGGATTGGTGGAAAGACGCCGCTGCCGACCGAAAA |
| 36 | 100.0 | 37 | CGACCGAAAA | .................................... | ACCCGGATTGGTGGAAAGACGCCGCTGCCGACCGAAAA |
| 36 | 100.0 | 41 | CGACCGAAAA | .................................... | GGGAAAACGTGGGCGCAACTTTGCTATTCTGGCATGTTTGC |
| 36 | 100.0 | 37 | GCATGTTTGC | .................................... | AAGTTTGGAAGGGGCGATAGCGATGGGTTTTAAGAT |
| 36 | 100.0 | 35 | GTTTTAAGAT | .................................... | CCGATCACCGTCAAAACCGTAGTAGTAAGACTCGC |
| 36 | 100.0 | 35 | TAAGACTCGC | .................................... | AAGGCGGCCTAAAATCACTTGGGCCGCCCTTAAGAT |
| 36 | 100.0 | 40 | CCCTTAAGAT | .................................... | TGCTTTTATTTCCATGCGTACCCATTGGCTGAATCGGGACTG |
| 36 | 100.0 | 36 | ATCGGGACTG | .................................... | AAACAGGTATCTGCTTATCAACGTGCAGCACAGGCG |
| 36 | 100.0 | 36 | AGCACAGGCG | .................................... | CTATATGAGTAGAACGTCTCTCAATAAGCGTAGAAT |
| 36 | 100.0 | 35 | AGCGTAGAAT | .................................... | GCGCCTTGTTGCTATCATTAGGGTCGCGATCAACA |
| 36 | 100.0 | 42 | GCGATCAACA | .................................... | GTATAACTTTTAGATAACAAATGTTATACAAAATGCTTGACG |
| 36 | 100.0 | 35 | ATGCTTGACG | .................................... | AGCCCAAGCTTTACATACACCTATGCGTATGCTTT |
| 36 | 100.0 |    | CGTATGCTTT | .................................... | TCCTTCCCAC |
| 36 |       | 37 |            | GTGCTAACCACGAAGCTTTCCACTAAGCTTTCGAAC | SEQ ID NO: 1381 |

Array 2
>gi|651512587|ref|NZ_KI301973.1|:310311-325637 Bacillus sp. NSP2.1 scaffold00005, whole genome shotgun sequence SEQ ID NOs: 1382-1390

| Repeat | %id | Spacer | Left flank | Repeat | Spacer |
|---|---|---|---|---|---|
| 36 | 94.4 | 38 | TGGACAAGCT | ........C..A................... | CTCTGGTGTAAGGCGGTTTCTTGCTTGTAAGTGCGCGG |
| 36 | 100.0 | 38 | AAGTGCGCGG | .................................... | AAAAGAGTATAAGTACCACTCTTAGCCGAGTAGTTCAA |
| 36 | 100.0 | 34 | AGTAGTTCAA | .................................... | ACTGGAGAACCTTCCAAGTGTGCGGATAGCGTATC |
| 36 | 100.0 | 34 | ATAGCGTATC | .................................... | TTTTTTGTTCCGCCAAGGTAAAACGTACCGAGTT |
| 36 | 100.0 | 37 | GTACCGAGTT | .................................... | TTTCCGTAAAACTTTTTGAGAAAACAGGAGGGGCGACT |
| 36 | 100.0 | 40 | GAGGGGCGACT | .................................... | CAGGCTTTTTGTGCATAGGTCATGCAGTAACCTAATCCGC |
| 36 | 100.0 | 39 | CCTAATCCGC | .................................... | GACCATGATCTCGAAAAGAAAATTACGCGTGCATCGCAA |
| 36 | 100.0 | 38 | TGCATCGCAA | .................................... | TGGGCCGCTCCCGATTCGATAAAGACGGGTATCTGGAGA |
| 36 | 100.0 |    | TATCTGGAGA | .................................... | CAGGGTACCC |
| 36 |      | 37 |            | GTGCTAATCCCGAAGCTTTCCACTAAGCTTTCGAAC | SEQ ID NO: 1391 |

Array 3
>gi|651512587|ref|NZ_KI301973.1|:310311-325637 Bacillus sp. NSP2.1 scaffold00005, whole genome shotgun sequence SEQ ID NOs: 1392-1404

| Repeat | %id | Spacer | Left flank | Repeat | Spacer |
|---|---|---|---|---|---|
| 35 | 100.0 | 37 | GCTACCCTCTG | .................................... | GTTCGGCCGTAGTAGTGTACACGGCTCTTGAATATGATG |
| 35 | 100.0 | 36 | GAATATGATG | .................................... | GCCCCAACGTCCTCCGAGAGAGGCCCACGTTCAGAG |
| 35 | 100.0 | 35 | ACGTTCAGAG | .................................... | GCGACCACTCCGAGCAGGGCAATCCCGACAATGCG |
| 35 | 100.0 | 36 | CGACAATGCG | .................................... | AACCCGAAGGGACTACACCATTTCCCGTGATAAAGCCG |
| 35 | 100.0 | 36 | TGATAAAGCCG | .................................... | AAAAGCTTGGGGAGGGCTTCCAGTCGGGTATACAGG |
| 35 | 100.0 | 34 | GGTATACAGG | .................................... | CCTTGTCCGCGATAAATCTGTACGTCGAATCCGT |
| 35 | 100.0 | 36 | TCGAATCCGT | .................................... | TGTTTGGCTTGCTGCCGCCCAAGTTGTCTGACAGT |
| 35 | 100.0 | 39 | GTCTGACAGT | .................................... | CCGTTATTAAGTTACCGCTTTTCTAGCATAACCTGACTGT |
| 35 | 100.0 | 43 | ACCTGAGTGT | .................................... | ATGTACAATCCTGCATCAGTCGAAGGAAGCGGGATCAGCTAGT |
| 35 | 100.0 | 41 | ATCAGCTAGT | .................................... | CAAGAGACGTGTTGACGGATCATCTTTTTTGAGATCTGCCGT |
| 35 | 100.0 | 42 | GATCTGCCGT | .................................... | GCGAACTTCTTGCAAAGTTTTTTGAGCAACATTTTTTCCGT |
| 35 | 100.0 | 37 | TTTTTTCCGT | .................................... | TCAACCATACTTATTTATTTTAGCACTGCCCCAAAGT |
| 35 | 100.0 |    | GCCCCAAAGT | .................................... | AACCTCTGCTG |
| 35 |      | 3 |             | GTACATCCCCTTCAATTTCCACTAAGCTTTCGAAC | SEQ ID NO: 1405 | dG = -4.45   dH = -70.70   dS = -213.61   Tm = 57.8 °C

```
           10           20
GTGCTAACCA  -|       TC
          CG AAGCTT  C       SEQ ID NO: 1406
          GC TTCGAA  A
CAA------- T^       TC
           30
```

FIG. 41G

*10: Desulfatirhabdium butyrativorans DSM 18734 G492DRAFT_scaffold00017.17, whole genome shotgun sequence*

| | Repeat | %id | Spacer | Left flank | Repeat | Spacer |
|---|---|---|---|---|---|---|
| SEQ ID NOs: 1407-1409 | 38 | 92.1 | 36 | CCCATCCATT | -....C............C.............. | GGCCACCCAGGCAGCCAACACCACCCAGGCCGAGCT |
| | 38 | 100.0 | 35 | AGGCCGAGCT | ................................. | TTGAATTGAGACGGTTCCGGAGCGCAATATGGTGA |
| | 38 | 100.0 | | AATATGGTGA | ................................. | CCCCGGCCATC |
| | 38 | | 35 | | GTGTCAGTCGATCAAGCTGTTTTCACCATCGGAACCCC | SEQ ID NO: 1410 | dG = -0.87   dH = -34.40   dS = -108.11   $T_m$ = 45.0 °C

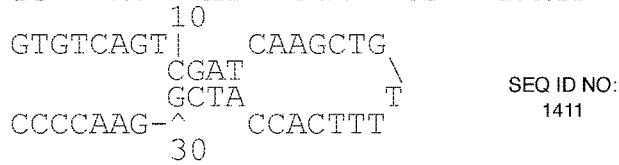

SEQ ID NO: 1411 dG = -0.48   dH = -45.60   dS = -145.48   $T_m$ = 40.3 °C

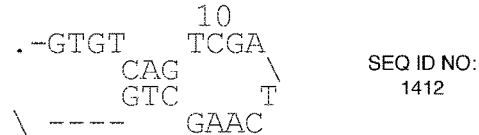

SEQ ID NO: 1412

SEQ ID NO: 1413

*15:16: Brevibacillus agri BAB-2500 contig150, whole genome shotgun sequence*
Array 1
>gi|433547010|ref|NZ_AOBR01000150.1|:1 - 9809 Brevibacillus agri BAB - 2500 contig150, whole genome shotgun sequence

| | Repeat | %id | Spacer | Left flank | Repeat | Spacer |
|---|---|---|---|---|---|---|
| SEQ ID NOs: 1414-1423 | 36 | 100.0 | 36 | CGAGGATTTT | ................................. | CATACCGCCGTTTACTTTACCTGGTACGGGGACTAT |
| | 36 | 100.0 | 35 | CGGCGACTAT | ................................. | TCTGCAAGTGCGCGTCTATGAAAAGAACTGGGAAA |
| | 36 | 100.0 | 40 | AACTGGGAAA | ................................. | GTTCAACCTTCTTCGTGAGAAAATTCATGATATTTTGAAG |
| | 36 | 100.0 | 39 | TATTTTGAAG | ................................. | CGGATCACTCTCAACAGCTCCATTACAACGATACTTATT |
| | 36 | 100.0 | 37 | GATACTTATT | ................................. | GAAGTTATGAAGAAAGTCTAGCATGTATTCCCGATGT |
| | 36 | 100.0 | 38 | TTCCCGATGT | ................................. | CATCAACAGCAACATCAACACGAGATCGAGGTTGAGGC |
| | 36 | 100.0 | 35 | AGGTTGAGGC | ................................. | CTCTGTTTGCAGCAGCATACTTCAAAAAGTCTTCA |
| | 36 | 100.0 | 39 | AAAGTCTTCA | ................................. | ATAATCCGTTTGCTGTACGGATATAAAAATCTTGTATAG |
| | 36 | 100.0 | 34 | TCTTGTATAG | ................................. | CGTATGCGAAGTCTGTTATACACCGCATTTTATG |
| | 36 | 100.0 | | GCATTTTATG | ................................. | TCCTTCCCACT |
| | 36 | | 37 | | GTGCTAACCACGAAGCTTTCCACTAAGCTTTCGAAC | SEQ ID NO: 1424 |

FIG. 41H

Array 2
>gi|433547010|ref|NZ_AOBR01000150.1|:1 - 9809 Brevibacillus agri BAB - 2500 contig150, whole genome shotgun sequence

| Repeat | %id | Spacer | Left flank | Repeat | Spacer |
|---|---|---|---|---|---|
| 36 | 94.4 | 41 | TGGACAAGCT | ........C.A................. | TTCTTAACACGCGACGACTCTTTCCCCACAGGATTTCGATG |
| 36 | 100.0 | 38 | GATTTCGATG | ............................. | AACTATAACATAACCCAAGCAACCGGCTTATAGTTTCTG |
| 36 | 100.0 | 40 | ATAGTTTCTG | ............................. | ACCAGCGCCTTGTCTGCCATGTATTGCTGTGCCAAAGCCA |
| 36 | 100.0 | 35 | GCCAAAGCCA | ............................. | TAACCGTAAGCCTGTAACGAAGCGTTGCTCCAAC |
| 36 | 100.0 | 36 | TGCCTCCAAC | ............................. | TGGGACGGGTGCACAGCAGACCGTAAAAGGATGCGTT |
| 36 | 100.0 | 36 | AAGATGCGTT | ............................. | ATCTAGTCACCCCAAGGATAATGTCGTCGTAGTCC |
| 36 | 100.0 | 36 | GTCGTAGTCC | ............................. | CTCTAGCTTGCCTGTCGAAGTTAGCCCTACTGTTGATGA |
| 36 | 100.0 | 36 | CTGTTGATGA | ............................. | ATCTGATCACGGGTAGCAACCGCCCGCAGTCAGGTCTT |
| 36 | 100.0 | 36 | GTCAGGTCTT | ............................. | GAGGACGTGTCTGTCAACGGGTATTGGACCGTTCC |
| 36 | 100.0 | 36 | GACCGTTCC | ............................. | AGGGAGTGGATTTTAGAGAGGGGTTGGTTTTGTTTCTA |
| 36 | 100.0 | 36 | TTTGTTTCTA | ............................. | ATTTTCGTTGCCCAGACGGGAGAGAGGAAGAGAGT |
| 36 | 100.0 | 36 | GGAAGAGAGT | ............................. | TCTCCTGATACCGCCCCATCAGATTGCTTTTCTAGCA |
| 36 | 100.0 | 36 | TTTTCTAGCA | ............................. | TCATATTTATCTGTAAGCTTCCCTCACTCATTTTTA |
| 36 | 100.0 | 36 | CTCATTTTTA | ............................. | TTGATGTTCGGCTAAGGCTAAGGACAGAGTCTAAGG |
| 36 | 100.0 | 36 | AGAGTCTAAGG | ............................. | GTCCTGACATACCGATGTTGGGGCTCGGTCGAAGT |
| 36 | 100.0 | 40 | CGGTCGAAGT | ............................. | GCCATCGCCGAGCCTTGCGGACCTCTTCTTTCGGATAC |
| 36 | 100.0 | 36 | TTCCGGATAC | ............................. | CCCAGGAACTTATATCGGCAATACTAGCTGTCTG |
| 36 | 100.0 | 36 | TAGCTGTCTG | ............................. | GTGCCGCGGATAGGAGATCAAGCACCGAAGCTAA |
| 36 | 100.0 | 36 | GCAAGCTAA | ............................. | TGCCACATTTCTACAGGGGTGGGGGTCAGGGAGC |
| 36 | 100.0 | 39 | GTCAGCGAGC | ............................. | GTAACTTGCTTACTCAAAGTAAGCGGTGTAGTCACCCGCCG |
| 36 | 100.0 | 38 | TCACCCGCCG | ............................. | GGACGAATTCGACTTCGTCCGTATGGGCGACTATATGA |
| 36 | 100.0 | 38 | GACTATATGA | ............................. | ACTATGGCAGGATTGGCAGAACTTTCGCCGTTTTTCA |
| 36 | 100.0 | 38 | CGTTTTTCA | ............................. | CCCCTTTTGGGTCTTCGTGAGTCGATGCAGTTGCCGTATCTA |
| 36 | 100.0 | 38 | TGCCGTATCTA | ............................. | CCACGTGGCGAAAGCAAGTTTTTCCATATCGTCAATAA |
| 36 | 100.0 | 35 | ATCGTCAATAA | ............................. | CTTCTATTTTTGGGGAGTTGGTGCTTGTGATGGTGGGG |
| 36 | 100.0 | 35 | GATGGTGGGG | ............................. | TTCTATTGGGTATTCACTCCCCATCCCGTCTCATGCT |
| 36 | 100.0 | 37 | TCTCATGGT | ............................. | GCTAGCCGTGGACAAGGAAGAAATAAAGGAACTCATT |
| 36 | 100.0 | 36 | GGAACTCATT | ............................. | TACCACTACCTCAAGCCTCCCGTTCGAAACCATCATG |
| 36 | 100.0 | 34 | AACCATCATG | ............................. | TATACAGGCCCGTTTTTGATCGTCGATGCTGGA |
| 36 | 100.0 | 36 | CGATGCTGGA | ............................. | GGTTTCTTGATGAAACGCAGCGCGTCCGTAAAGGAT |
| 36 | 100.0 | — | CGTAAAGGAT | ............................. | CCCTGTCTTC |

SEQ ID NOs: 1425-1456

| 36 | 37 | GTGCTAATCCCGAAGCTTTCCACTAAGCTTTCGAAC | SEQ ID NO: 1457 | dG = -4.45   dH = -70.70   dS = -213.61   Tm = 57.8 °C

```
              10           20
GTGCTAACCA - |           TC
           CG  AAGCTT    C      SEQ ID NO: 1458
           GC  TTCGAA    A
CAA------- T^           TC
              30
```

*17: Brevibacillus sp. CF112 PMI08_contig_212.212, whole genome shotgun sequence*

>gi|399056144:24829_25225 Brevibacillus sp. CF112 PMI08_contig_212.212, whole genome shotgun sequence GTGCTAACCACGAAGCTTTCCACTAAGCTTTCGAACGCTTACAGCTTCCGGTCAACCCCGCATCCATCCG
cATAGTGCTAATCCCGAAGCTTTCCACTAAGCTTTCGAACTCAAGATCGAGGCACTGTACCCGGGCACGA
AAGGGTGCTAATCCCGAAGCTTTCCACTAAGCTTTCGAACTTAATATCTTGGTTGTAGTTGCGCAAACCT
TTTATGTGCTAATCCCGAAGCTTTCCACTAAGCTTTCGAACCCTTACTCAGTTTGCGTCCTCCGAAGAAGT
CGTCCATAAGTGCTAATCCCGAAGCTTTCCACTAAGCTTTCGAACGCGACACGACCGTATTCGTGGACGA
GCCGGTCTTTGTGTGCTAATCCCGAAGCTTTCCACTAAGCTTTCGAA          SEQ ID NO: 1459 dG = -4.45   dH = -70.70   dS = -213.61   Tm = 57.8 °C

```
              10           20
GTGCTAACCA - |           TC
           CG  AAGCTT    C
           GC  TTCGAA    A      SEQ ID NO: 1460
CAA------- T^           TC
              30
```

FIG. 41I

18: *Methylobacterium nodulans ORS 2060, complete genome*
>gi|220920054|ref|NC_011894.1|:620239-630215 Methylobacterium nodulans ORS 2060, complete genome

| Repeat | %id | Spacer | Left flank | Repeat | Spacer |
|---|---|---|---|---|---|
| 36 | 97.2 | 34 | AACAGATGT | .........A........................ | CCCCGTGTCCACATGACGGCCGGATGCACCA |
| 36 | 100.0 | 35 | CGATGCACCA | .................................... | TTCCGGCGACCCTGGATCTGCACGGCTACACAACT |
| 36 | 100.0 | 35 | CTACACAACT | .................................... | TTGGCCCCGCGCACCGGGTAGGAGACCCGCCAT |
| 36 | 100.0 | 35 | GACCCGCCAT | .................................... | ATAGTTCTGGCTGTTGGAGGCCAGATTGTTCTG |
| 36 | 100.0 | 33 | GATTGTTCTG | .................................... | CTGACCTTCACGCGTGTCTACTCGGGCGTGGCAA |
| 36 | 100.0 | 35 | GGCTGGCCAA | .................................... | GTCCAGGCCGAGTTGGGCAAGGTCCCCGGATCCT |
| 36 | 100.0 | 35 | GCCGGATCCT | .................................... | GGCGGGCACG |

SEQ ID NO: 1461 - 1467

SEQ ID NO: 1468

| 36 | | 34 | | GTGCCAACGCGCTCAGGATCTGGGCCCCACTGCGAC | |

SEQ ID NO: 1469 dG = -4.37   dH = -61.10   dS = -182.91   Tm = 60.9 °C

```
           10        GCGC  CAG  G
GTGCCAAC---|        CGCG  GTC  A
CAGGGTCACC^        -       T
         30        20
```
SEQ ID NO: 1470 dG = -4.27   dH = -54.90   dS = -163.24   Tm = 63.2 °C

```
         C             CC
--GTGCC  A             CGC  \
  CGCG   A             GCG  A
       \  10       ^   TC
TCAGGATCTGG|           30
         20
CA--------^
```
SEQ ID NO: 1471

FIG. 41J

| No | Repeat | Species | SEQ ID NO: |
|---|---|---|---|
| 1 | GTGGGATCACTGAGCGAGCGATCTGAGAAGTGGCAC | Alicyclobacillus acidoterrestris ATCC 49025 contig_26, whole genome shotgun sequence | 1472 |
| 4 | GTCTCGGCAAGCTTGGTCAGTGTTGGGTGATTGGCAC | Desulfonatronum thiodismutans strain MLF1 contig6, whole genome shotgun sequence | 1473 |
| 5 | CCGCCTGACGATTCGTGAAACGGCATTCGCTGCGGC | Opitutaceae bacterium TAV5, complete genome | 1474 |
| 7 | GTCCAAGAAAAAAGAAATGATACGAGGCATTAGCAC | Bacillus thermoamylovorans strain B4166 NODE_401, whole genome shotgun sequence | 1475 |
| 9 | GTGCTAACCACGAAGCTTTCCACTAAGCTTTCGAAC | Bacillus sp. NSP2.1 scaffold00005, whole genome shot gun sequence | 1476 |
| weak | | | |
| 10 | GTGTCAGTCGATCAAGCTGTTTCACCATCGGAACCCC | Desulfatirhabdium butyrativorans DSM 18734 G492DRAFT_scaffold00017.17, whole genome | 1477 |
| 15,16 | GTGCTAACCACGAAGCTTTCCACTAAGCTTTCGAAC | Brevibacillus agriBAB-2500 contig150, whole genome shotgun sequence | 1478 |
| 17 | GTGCTAACCACGAAGCTTTCCACTAAGCTTTCGAAC | Brevibacillus sp. CF112 PMI08_contig_212.212, whole genome shotgun sequence | 1479 |
| 18 | GTGCCAACGCGCTCAGGACTTCGCGCCCACTGGGAC | Methylobacterium nodulans ORS 2060, complete genome | 1480 |

| ID | Input | SEQ ID NO: | Structures | Sequences | Superclass | cas Subtype |
|---|---|---|---|---|---|---|
| 1 | GTGGGATCACTGAGCGAGCGATCTGAGAAGTGGCAC | 1481 | - | - | C | III-B |
| 4 | GTCTCGGCAAGCTTGGTCAGTGTTGGGTGATTGGCAC | 1481 | motif 18 | - | - | II-C |
| 5 | CCGCCTGACGATTCGTGAAACGGCATTCGCTGCGGC | 1483 | motif 18 | - | F | III-B |
| 7 | GTCCAAGAAAAAAGAAATGATACGAGGCATTAGCAC | 1484 | - | - | C | II-C |
| 9 | GTGCTAACCACGAAGCTTTCCACTAAGCTTTCGAAC | 1485 | - | - | E | - |
| 10 | GTGTCAGTCGATCAAGCTGTTTCACCATCGGAACCCC | 1486 | motif 18 | - | - | - |
| 15_16 | GTGCTAACCACGAAGCTTTCCACTAAGCTTTCGAAC | 1487 | - | - | E | - |
| 17 | GTGCTAACCACGAAGCTTTCCACTAAGCTTTCGAAC | 1488 | - | - | D | - |
| 18 | GTGCCAGTGGGCCCAGATCCTGAGCGCGTTGGCAC | 1489 | - | family 17 | F | II-A |

FIG. 41K

| SEQ ID NO: | NO | ARRAY NO | REPEAT | SPACER | DOWNSTREAM |
|---|---|---|---|---|---|
| 1490 1500 1510 | 1 | 1 | GTCGGATCACTGAGCGAGCGATCTGAGAAGTGGCAC | TGATGTCAGCGAAACGACCACCATCGGGGTTATAAC | GTCGGATCACTGAGTGATCTAACCTATCAAATGCCCAAACCACCTCCTGCGGGGTTCGAATCCCTTCGAGTGCGCCACAAACATAAGTAAAACGCCGGATTCAGTTTATCGAGTCCAGCGTTTTTCTTTTCTACTGCAGTGTTCTACGCATCTTACTATGCCGTTGTAATACGAAGATTTGCGAACATCTTGGAATACAG |
| 1491 1501 1511 | 4 | 1 | GTCTCGGCAAGCTTGGTCAGTGTTGGGTGATTGGCAC | GGGTGCGGCATTTGCGGGTGTTGGGGGAGTGGCAGG | GTCTCGGCAAGCTTGGTCAGTGATGGGTGATTGACATCAGTGATGGGTGATTGACACTAGAAGCGCACGGCCTAGGTTACGTTCTTGGGGAAAGCTAGGCAAGTTTTGGATGATAAGAAATAATCATGTCACAAGGAGGGAGTTTTTGTGGCGAGAATCACCATGTATCGAATTCAAATCAATACAGAAGCTATAAGAAA |
| 1492 1502 1512 | 5 | 1 | GCCGCAGTGAATGCCGTTTCACGAATCGTCAGGCGG | CAGTGGATGTTTTTCCATGAGGCGAAGAATTTCATC | GCCGCAGTGAATGCCGTTTCACCATTGATGAAGAATGCGAGGTGAAAACAGAGAAATTGGGTCAACTCTATCACTCTTATTCAGCCATCGTTTCAAGAAAGGATACCTCGTATTGGATACAACACAGCTCGTTCGTTCTCTCTACCTCCCTCGACAATCTCAAGGACTATGGCGATGCCAGCGATGGAACAGCCGAGGCA |
| 1493 1503 1513 | 7 | 1 | GTCCAAGAAAAAAGAAATGATACGAGGCATTAGCAC | AACAATATAAACGACTACTTTACCGT | GTTCAAGAAAAAGAAATGATATGAGGCATTAGCACGATGGGATGGGAGAGAGAGGACAGTTCTACTCTTGCTGTATCCAGCTTCTTTTTACTTTATCCGGTATCATTTCTTCACTTCTTTCTGCACATAAAAAAGCACCTAACTATTTGGATAAGTTAAGTGCTTTTATTTCCGTTTGAAGTTGTCTATTGCTTTTTTCT |
| 1494 1504 1514 | 9 | 2 | GTTCGAAAGCTTAGTGGAAAGCTTCGTGGTTAGCAC | AGCTTGTCCAACTTGATGCTCCTTTTCATC | GTTCGAAACTTGGTGAAATACCTTGAAAATTAACACATCAAAGATGCCCCTGCTTTACGTTAGGGGCATCTTTCTATTAAATAACCTATAGTGAACTTCAAAATCATTGATCTCTTGATAATAATATATACCAAATTCAATAGTCATAGTGAGAGGTTTACAGGTGCTCGATACGTTTTCTTGCAAAAAGAAGCAGTC |
| 1495 1505 1515 | 9 | 3 | GTTCGAAAGCTTAGTGGAAATTGAAGGGGATGTACCA* | ATCATATTCAAGAGCGTGTACACTACTACGCCGAAC | GTTCGAAAGCTTAGTGGAAATTGAAGGGGATGTACCAGAGGTAGCACTTAGCAAGTTTTTTGAGAAACAAGTATCTGGCCCCAATAGCTAGGCTTATGTGAAATGTAGCATGAGTGGTGTGCAATGAAAAAAATAGGGAGGATATTAGCACTATGAAAAAGCAGCTTAAAAAAACAGTTAAATGCGTGATGGCGTCTATAT |
| 1496 1506 1516 | 10 | 1 | GGGGTTCCGATGGTGAAAACAGCTTGATCGACTGAC | ACAGCTCGGCCTGGGTGGTGTTGGCTGCCTCGGTGGCC | GGGGTTCCGATGGTGAAAGCAGCTTGATCGACGGACAAATGGATGGGCATGCGTAGGGGCGGTTCGCGAACCGCCCCTACAACTACACCGAAAGATACCGCGACTGAATCTGGTGTTGGCCAGAAGCTCCTGCCTGGTGCCTTCGTAGCGGATGAGGCCTTTGTCGATGACATAGCCCCGATCGGAGATGGAGAGGGCG |
| 1497 1507 1517 | 15 | 2 | GTTCGAAAGCTTAGTGGAAAGCTTCGTGGTTAGCAC | AGCTTGTCCAACTTGATGCTCCTTTTCATC | GTTCGAAAACTTGGTGAAATACCTTGAAAATTAACACATCAAAGATGCCCCTGCTTTACGTTAGGGGCATCTTTCTATTAAATAACCTATAGTGAACTTCAAAATCATTGATCTCTTGATAATAATATATACCAAATTCAATAGTCATAGTGAGAGGTTTACAGGTGCTCGATACGTTTTCTTGCAAAAAGAAGCAGTC |
| 1498 1508 1518 | 17 | 1 | GTTCGAAAGCTTAGTGGAAAGCTTCGTGGTTAGCAC | AGCTTGTCCAACTTGATGCTCCTTTTCATC | GTTCGAAAACTTGGTGAAATACCTTGAAAATTAACACATCAAAGATGCCCCTGCTTTACGTTAGGGGCATCTTTCTATTAAATAACCTATAGTGAACTTCAAAATCATTGATCTCTTGATAATAATATATACCAAATTCAATAGTCATAGTGAGAGGTTTACAGGTGCTCGATACGTTTTCTTGCAAAAAGAAGCAGTC |
| 1499 1509 1519 | 18 | 1 | GTCTCAACGGGCGCCAGTTCCTGAGCTCGTTGGCAC | TGCATGCGCTCCTCGAGGCGGAGGATCCGATCGC | GTCGCAACGGATCCCAGATCCTGATCTCGCTGGCAGGTGCCCTGGTAGATGACGACTCGCGCTCGTTGCAGGGAGGCTCGCGCAGACAGCGGGAAACTGCTTGTCAGGCAATCGCCTGTGCTGGGTCCGCTGGATTCTGTGTTCGTTGGCACGGGGGAGCCGTGGGAATGCCTACTGCCTGGATGGGGTCGCACCAGT |

*: PREVIOUS TO THE LAST REPEAT ALSO HAVE MUTATION, NORMAL REPEAT IS
GTTCGAAAGCTTAGTGGAAATTGAAGGGGATGTACCC  SEQ ID NO: 1520

FIG. 41L

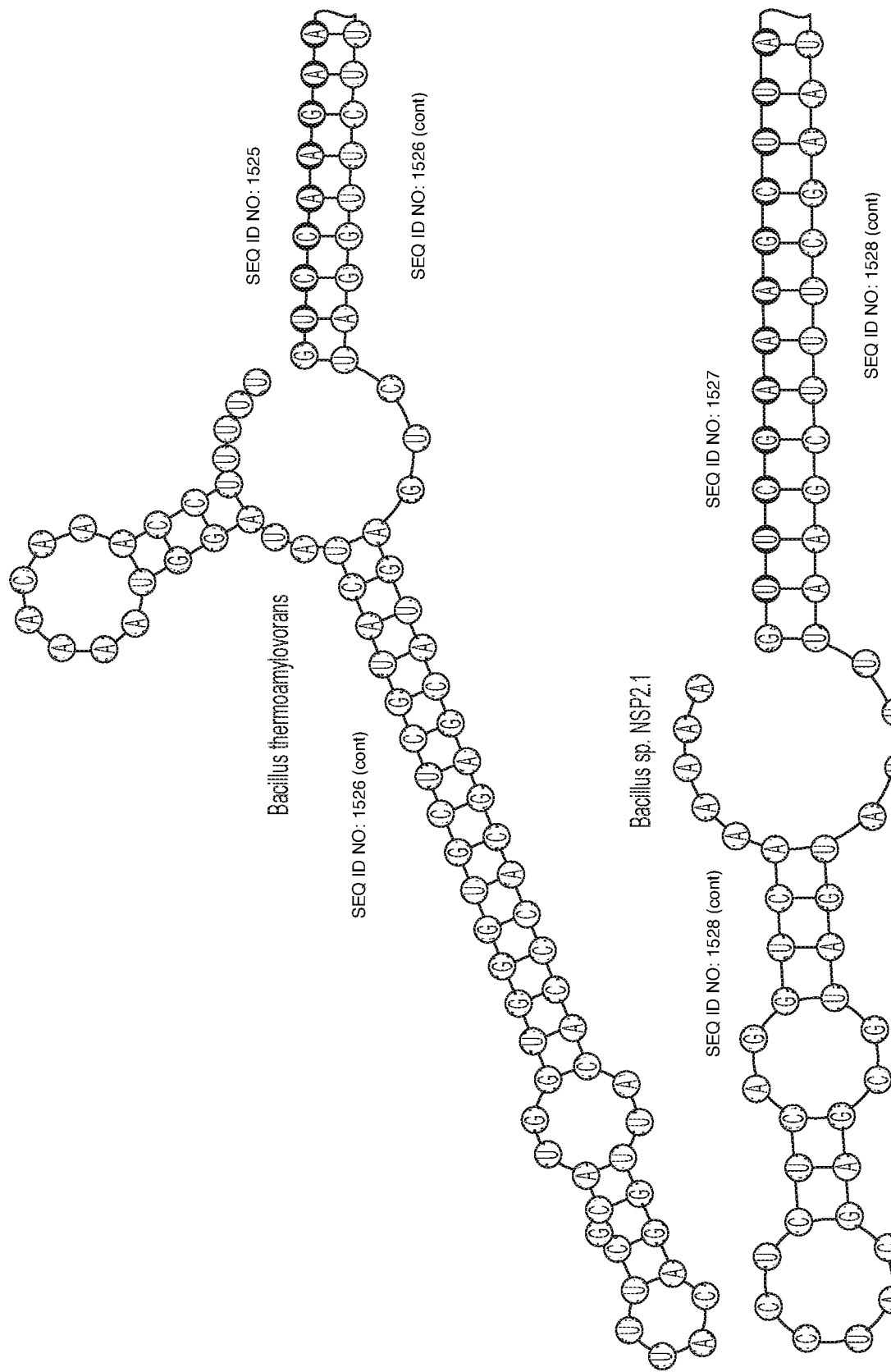

| Locus No | Locus Structure* | Species Name and Link to NCBI genome viewer |
|---|---|---|
| 1 | [D]CRISPR1-<cas2-<casCandidate-<<unk<->[T] | Lachnospiraceae bacterium MA2020 T348DRAFT_scaffold00014.14_C, whole genome shotgun sequence http://www.ncbi.nlm.nih.gov/projects/sviewer/?id=NZ_JOKK01000015.1&v=87000:97000 |
| 2 | CRISPR1-<[T]-<5kb(4 unk prot)-<unk-<casCandidate-unk-[D]CRISPR2 | Lachnospiraceae bacterium NK4A179 G621DRAFT_scaffold00054.54_C, whole genome shotgun sequence http://www.ncbi.nlm.nih.gov/projects/sviewer/?id=NZ_ATWO01000054.1&v=1:11000 |
| 3 | CRISPR1[D]->[T]->unk->cas1->5kb(4 unk proteins)->casCandidate> | [Clostridium] aminophilum DSM 10710 BR860DRAFT_scaffold00011.11_C, whole genome shotgun sequence http://www.ncbi.nlm.nih.gov/projects/sviewer/?id=NZ_JONJ01000012.1&v=1000:15000 |
| 4 | <cas1>->cas2>-CRISPR1[D]>casCandidate> | Lachnospiraceae bacterium NK4A144 G619DRAFT_scaffold00027.27_C, whole genome shotgun sequence http://www.ncbi.nlm.nih.gov/projects/sviewer/?id=NZ_AUTJ01000030.1&v=11000:22000 |
| 5 | <casCandidate-[D]CRISPR1[D]-<Integrase-<Transposase-CRISPR2 | Carnobacterium gallinarum DSM 4847 strain MT44 BR43DRAFT_scf7180000000012_quiver_C, whole genome shotgun sequence http://www.ncbi.nlm.nih.gov/projects/sviewer/?id=NZ_JQLU01000005.1&v=159241:169768 |
| 6 | <transposase>-integrase>-CRISPR1[D]->casCandidate>-CRISPR2[D] | Carnobacterium gallinarum DSM 4847 strain MT44 BR43DRAFT_scf7180000000012_quiver_C, whole genome shotgun sequence http://www.ncbi.nlm.nih.gov/projects/sviewer/?id=NZ_JQLU01000005.1&v=2455080:2467000 |
| 7 | unk-[D]CRISPR1->casCandidate-<unk | Paludibacter propionicigenes WB4, complete genome gi|313202490|ref|NC_014734.1| http://www.ncbi.nlm.nih.gov/projects/sviewer/?id=NC_014734.1&v=221749:233213 |
| 8 | Transposase->unk->[D]CRISPR1->casCandidate->[T]->Transposase | Listeria seeligeri serovar 1/2b str. SLCC3954 complete genome http://www.ncbi.nlm.nih.gov/projects/sviewer/?id=NC_013891.1&v=1171428:1181790 |
| 9 | [D]CRISPR1->unk->>casCandidate>-[D]CRISPR2 or [D]CRISPR1->casCandidate>-[D]CRISPR2 | Listeria weihenstephanensis FSL R9-0317_04, whole genome shotgun sequence http://www.ncbi.nlm.nih.gov/projects/sviewer/?id=NZ_AODJ01000004.1&v=41000:48000 |
| 10 | <unk-<[D]CRISPR1->casCandidate>->unk> | Listeria newyorkensis strain FSL M6-0635 contig000012, whole genome shotgun sequence http://www.ncbi.nlm.nih.gov/projects/sviewer/?id=NZ_JNFB01000012.1&v=168000:175000 |
| 11 | <cas2-<cas1-<casCandidate-<AntiToxin-<ToxinK | Leptotrichia wadei F0279 Scaffold823, whole genome shotgun sequence http://www.ncbi.nlm.nih.gov/projects/sviewer/?id=NZ_KI271424.1&v=220061:231554 |
| 12 | CRISPR1->[T]-<cas2-<cas1-<casCandidate-<AntiToxin-<ToxinK | Leptotrichia wadei F0279 Scaffold804, whole genome shotgun sequence http://www.ncbi.nlm.nih.gov/projects/sviewer/?id=NZ_KI271421.1&v=62000:71000 |
| 13 | <casCandidate-<AntiToxin-<Toxin | Leptotrichia buccalis DSM 1135, complete genome http://www.ncbi.nlm.nih.gov/projects/sviewer/?id=NC_013192.1&v=1976459:1987938 |
| 14 | >Toxin>>AntiToxin>>unk>>casCandidate>->unk> | Leptotrichia sp. Oral taxon 225 str. F0581 Scaffold136, whole genome shotgun sequence http://www.ncbi.nlm.nih.gov/projects/sviewer/?id=3456618306v=12000:18000 |

FIG. 42A

| | | |
|---|---|---|
| 15 | <cas2<-<cas1<-<casCandidate<- | Leptotrichia wadei F0279 L_wadeiHMPREF9015-1.0_Cont41.1, whole genome shotgun sequence http://www.ncbi.nlm.nih.gov/projects/sviewer/?id=AWVM01000026.1&v=24000:32000 |
| 16 | <cas2<-<cas1<-<casCandidate<- | Leptotrichia wadei F0279 Scaffold41, whole genome shotgun sequence http://www.ncbi.nlm.nih.gov/projects/sviewer/?id=NZ_KI271395.1&v=24000:32000 |
| 17 | <cas2<-<cas1<-<casCandidate<- | Leptotrichia sp. Oral taxon 879 str. F0557 Scaffold38, whole genome shotgun sequence http://www.ncbi.nlm.nih.gov/projects/sviewer/?id=NZ_KI271320.1&v=14000:23000 |
| 18 | [D]CRISPR1-<<cas2<-<cas1<-<casCandidate<->[T]> | Leptotrichia shahii DSM 19757 B031DRAFT_scaffold_9.10, whole genome shotgun sequence http://www.ncbi.nlm.nih.gov/projects/sviewer/?id=NZKB890278.1&v=33000:41000 |
| 19 | <cas1<-[D]CRISPR1->casCandidate> | Rhodobacter capsulatus SB 1003, complete genome http://www.ncbi.nlm.nih.gov/projects/sviewer/?id=NC_014034.1&v=2154410:2166267 |
| 20 | <cas1<-[D]CRISPR1->casCandidate> | Rhodobacter capsulatus R121 seq0019, whole genome shotgun sequence http://www.ncbi.nlm.nih.gov/projects/sviewer/?id=AYOC01000019.1&v=320000:330000 |
| 21 | <cas1<-[D]CRISPR1->casCandidate> | Rhodobacter capsulatus DE442 seq0020, whole genome shotgun sequence http://www.ncbi.nlm.nih.gov/projects/sviewer/?id=NZ_AYPR01000020.1&v=460806:472663 |

FIG. 42B

1: Lachnospiraceae bacterium MA2020 T348DRAFT_scaffold00014.14_C, whole genome shotgun sequence

| SEQ ID NO: | Repeat | %id | Spacer | Left flank | Repeat | Spacer |
|---|---|---|---|---|---|---|
| 1529 | 35 | 94.3 | 36 | GAAGAAATGA | -- ................... | CCTTAGCGCGAAAATACCCCCTCGCCATAACCAACC |
| 1530 | 35 | 94.3 | 39 | ATAACCAACC | ............T..T.......... | TATCAAGGTACAGCAAATATGCTCATCAGTGCTATGAAG |
| 1531 | 35 | 94.3 | 37 | TGCTATGAAG | ............T..T.......... | AGTAGAAATGATTATACCTGACAACGTTAAAGAGAGT |
| 1532 | 35 | 94.3 | 34 | TAAAGAGAGT | ............T..T.......... | AAAAGAAACCAAAAAATTCATTTGCGTAACACCAT |
| 1533 | 35 | 100.0 | 35 | GTAACACCAT | ........................... | AAAATACGCACAGCCTCATTACCACTCAGTTTATT |
| 1534 | 35 | 100.0 | 35 | TCAGTTTATT | ........................... | TAAAATGGATGATTGGTGGCTCGATGACACTGTCC |
| 1535 | 35 | 100.0 | 37 | GACACTGTCC | ........................... | AGCTTCTAGTGGTATGCCTTCGGGACCATCAAAGGAA |
| 1536 | 35 | 100.0 | 36 | ATCAAAGGAA | ........................... | GCATATCTTGAGGATTGGGATTCTGAACTCTTAGAG |
| 1537 | 35 | 100.0 | 37 | ACTCTTAGAG | ........................... | CTCACTTATTCACCTGGGTTAACTGCATGAACTCAAC |
| 1538 | 35 | 97.1 | | TGAACTCAAC | ................T.......... | CCTACCTTCT |
| | 35 | | 36 | | GTCTATTGCCAACTATATCTGGCTTTTCTCAATAC | SEQ ID NO:1539 | dG = -2.66  dH = -37.30  dS = -11.69  $T_m$ = 60.8 °C

```
                 10
GTCTATT-----|  ACT
            GCCA   A        SEQ ID NO:1540
            CGGT   T
CATAACTCTTTT^  CTA
         30    20
```

2: Lachnospiraceae bacterium NK4A179 G621DRAFT_scaffold00054.54_C, whole genome shotgun sequence

| | Repeat | %id | Spacer | Left flank | Repeat | Spacer |
|---|---|---|---|---|---|---|
| 1541 | 35 | 97.1 | 33 | ACCTTCCAGA | .....................A.......... | TCATAATACCAAGAAGAAATCAAGCATATTATC |
| 1542 | 35 | 100.0 | 35 | GCATATTATC | ........................... | ACGAGATAGGCAAACCGAAGAACATGATATATATA |
| 1543 | 35 | 100.0 | 33 | GATATATATA | ........................... | GAATACGATACAACTGGCGACTGGTTTGATTAA |
| 1544 | 35 | 100.0 | | GTTTGATTAA | ........................... | ACCGTCCTCT |
| | 35 | | 33 | | GTTATTGCCCTCTATCTTGGGCTCTTCTCATCAAC | SEQ ID NO:1545 | dG = -3.65  dH = -41.20  dS = -121.07  $T_m$ = 67.1 °C

```
                 10
GTTATT-------|  TCT
             GCCC   A       SEQ ID NO:1546
             CGGG   T
CAACTACTCTTCT^  TTC
          30    20
```

FIG. 42C-1

SEQ ID NO: 3: [Clostridium] aminophilum DSM 10710 BR86DRAFT_scaffold00011.11_C, whole genome shotgun sequence

| SEQ ID NO: | Repeat | %id | Spacer | Left flank | Repeat | Spacer |
|---|---|---|---|---|---|---|
| 1547 | 35 | 100.0 | 35 | AAAGAGCAGG | ......................... | GCCTTTTGTCGCAAGTGTTGCCCGTACCGGATAACG |
| 1548 | 35 | 100.0 | 35 | CCGGATAACG | ......................... | GCAACATATGCTTCATCGGGGAAGAGTTCTTTCCC |
| 1549 | 35 | 100.0 | 35 | GTTCTTTCCC | ......................... | CCGGAAGCAATTCCCCCAATGGCCTGTCCAAGCCA |
| 1550 | 35 | 100.0 | 34 | GTCCAAGCCA | ......................... | TTAATTGCCGGATACTTGAGATGGAACTTGTCAC |
| 1551 | 35 | 100.0 | 33 | AACTTGTCAC | ......................... | ATATCATCATCAAGAGTCTGCCTTGCATCACAA |
| 1552 | 35 | 100.0 | 34 | TGCATCACAA | ......................... | GTTTATGTAAACTCTTAACGAGTAACCATCTTAA |
| 1553 | 35 | 97.1 | 36 | ACCATCTTAA | ..............A.......... | CAGACCATACCTTTTCAGACGGGATCTTTACCATCT |
| 1554 | 35 | 97.1 | 34 | TTTACCATCT | ..............A.......... | CTGATGCTGCGAATCTGCCAGAACTCTTGCGACC |
| 1555 | 35 | 100.0 | | TCTTGCGACC | ......................... | GGTGTACTTGT |
| | 35 | | 36 | | GTTTGGAGAACAGCCCGATATAGAGGGCAATAGAC | SEQ ID NO: 1556 | dG = -4.02  dH = -40.50  dS = -117.62  T$_m$ = 71.2 °C

```
           10        20
GTTTGGAGAACA|   GAT
               GCCC   A      SEQ ID NO: 1557
               CGGG   T
CAGATAA-----^  AGA
           30
```

FIG. 42C-2

SEQ ID NO: 4: Lachinospiraceae bacterium NK4A144 G619DRAFT_scaffold00027.27_C, whole genome shotgun sequence

| SEQ ID NO: | Repeat | %id | Spacer | Left flank | Repeat | Spacer |
|---|---|---|---|---|---|---|
| 1558 | 35 | 100.0 | 36 | AGAAGACAGG | ......................... | AACGGTTTTACCATTGTCAAACTCGCCTGCTGTCGT |
| 1559 | 35 | 100.0 | 39 | CTGCTGTCGT | ......................... | TTTTGCTTCGTCACGGATGGACTTCACAATGGCAACAAC |
| 1560 | 35 | 100.0 | 34 | TGGCAACAAC | ......................... | CTTCATAAATCCAAGATACGGATGCATGATTACG |
| 1561 | 35 | 100.0 | 32 | CATGATTACG | ......................... | TTTTAAAGGGATGATAAGGAAGCCGTATACTC |
| 1562 | 35 | 100.0 | 37 | CCGTATACTC | ......................... | CTAAGCTGGTTTTTTCCATGTTGACACCTTGCCTAGTT |
| 1563 | 35 | 100.0 | | TTGCCTAGTT | ......................... | TTCTTCTCTTGTCATTCTTCTACCTCTAAAATCTCA |
| | 35 | | 35 | | GTTTTGAGAATAGCCCGACATAGAGGGCAATAGAC | SEQ ID NO: 1564 | dG = -4.02  dH = -40.50  dS = -117.62  T$_m$ = 71.2 °C

```
           10       20
GTTTTGAGAATA|  GAC
              GCCCC  A    SEQ ID NO: 1565
              CGGG   T
CAGATAA-----^ AGA
           30
``` dG = -3.32  dH = -32.80  dS = -95.05  T$_m$ = 71.9 °C

```
           10      20
GTTTTGAGA|  A   GAC
           AT  GCCC  A     SEQ ID NO: 1566
           TA  CGGG  T
CAGA-----^     AGA
           30
```

FIG. 42D-1

5: Carnobacterium gallinarum DSM 4847 strain MT44 BR43DRAFT_scf7180000000012_quiver.5_C, whole genome shotgun sequence Array 1
>gi|736552370|ref|NZ_JQLU01000005.1|:158241-169768 Carnobacterium gallinarum DSM 4847 strain MT44 BR43DRAFT_scf7180000000012_quiver.5_C,whole genome shotgun sequence

| SEQ ID NO: | Repeat | %id | Spacer | Left flank | Repeat | Spacer |
|---|---|---|---|---|---|---|
| 1567 | 37 | 100.0 | 29 | AAAATGGAAA | ............................. | AAAAGATTACAATGAAGGTTATCCACTTC |
| 1568 | 37 | 100.0 | 29 | TATCCACTTC | ............................. | TAACTCATGGGATATGAATTATCATTTAG |
| 1569 | 37 | 97.3 | 29 | TATCATTTAG | .............................G | TATTAGGAACAATAAACGACTCTTTTTTA |
| 1570 | 37 | 100.0 | 29 | CTCTTTTTTA | ............................. | CAAATTAATCGTTCTCTTTATATCTGGGA |
| 1571 | 37 | 100.0 |   | ATATCTGGGA | ............................. | GATTATATCGAAAATCAAATAAATGCGCT |

|  | 37 |  | 29 |  | GTTATAGTCCTCTTACATTTAGAGGTAGTCTTTAATT | SEQ ID NO: 1572 |

Array 2
>gi|736552370|ref|NZ_JQLU01000005.1|:158241-169768 Carnobacterium gallinarum DSM 4847 strain MT44 BR43DRAFT_scf7180000000012_quiver.5_C, whole genome shotgun sequence

|  | Repeat | %id | Spacer | Left flank | Repeat | Spacer |
|---|---|---|---|---|---|---|
| 1573 | 36 | 100.0 | 30 | CCAATAAACG | ............................. | TCTCCTTTTTCATGAATGGCCGTTAACCCT |
| 1574 | 36 | 100.0 | 30 | CGTTAACCCT | ............................. | TGCGACAATCAGTATGATTACGATGCTGAC |
| 1575 | 36 | 100.0 | 30 | CGATGCTGAC | ............................. | TTTTACATAAAAAAAGGAGGGTATAATCAT |
| 1576 | 36 | 100.0 | 30 | GTATAATCAT | ............................. | TTACGCCAAGAATTATTAATGTTGATGCAA |
| 1577 | 36 | 100.0 | 30 | GTTGATGCAA | ............................. | CTTTATCCATGAATTAACTCATGCGATTGC |
| 1578 | 36 | 100.0 | 30 | ATGCGATTGC | ............................. | AGAAATATATTAATAGCGACTTATATTACA |
| 1579 | 36 | 100.0 | 30 | TTATATTACA | ............................. | ATATTGGAGAAAAAAGAAAAAGATTAGTCA |
| 1580 | 36 | 100.0 | 30 | AGATTAGTCA | ............................. | TCCTCTATTGTACTTAACATCATCTACTGA |
| 1581 | 36 | 100.0 | 30 | CATCTACTGA | ............................. | ACCCTTCTAT |

|  | 36 |  | 30 |  | GTTATAGTCCTCTTACATTTAGAGGTAGTCTTTAAT | SEQ ID NO: 1582 | dG = -2.63  dH = -42.50  dS = -128.55  $T_m$ = 57.5 °C

```
                    10
GTTATAGT----|   TAC
             CCTCT \
             GGAGA  A            SEQ ID NO: 1583
TTAATTTCTGAT^   TTT
          30    20
```

FIG. 42D-2

*6: Carnobacterium gallinarum DSM 4847 strain MT44 BR43DRAFT_scf718000000012_quiver.5_C, whole genome shotgun sequence*

Array 1
>gi|736552370|ref|NZ_JQLU01000005.1|:2455000-2467000 Carnobacterium gallinarum DSM 4847 strain MT44 BR43DRAFT_scf7180000000012_quiver.5_C, whole genome shotgun sequence

| SEQ ID NO: | Repeat | %id | Spacer | Left flank | Repeat | Spacer |
|---|---|---|---|---|---|---|
| 1584 | 37 | 100.0 | 29 | TCTAGTTCTG | .......................... | CCTCAATGCTTTTATTTTGAGCGTTCGCT |
| 1585 | 37 | 100.0 | 29 | AGCGTTCGCT | .......................... | ACCGACTAGAGAACTCTTTAGTCACTTGA |
| 1586 | 37 | 100.0 | 29 | AGTCACTTGA | .......................... | GCTTTTGTTAAATTGATTATTGGGTCTTC |
|  | 37 |  | 29 |  | ATTAAAGACTACCCCTAAATGTAAGGGGACTATAACT | SEQ ID NO: 1587 |

Array 2
>gi | 736552370 | ref | NZ_JQLU01000005.1 | :2455000-2467000 Carnobacterium gallinarum DSM 4847 strain MT44 BR43DRAFT_scf7180000000012_quiver.5_C, whole genome shotgun sequence

| | Repeat | %id | Spacer | Left flank | Repeat | Spacer |
|---|---|---|---|---|---|---|
| 1588 | 36 | 100.0 | 30 | GTTGAGGGGT | .......................... | TTTATTAGTTGTTCATCTGTTTTTTTTTAA |
| 1589 | 36 | 100.0 | 30 | TTTTTTTTAA | .......................... | CTACAAAAACGACTAAAAAAGCGTTTAAAG |
| 1590 | 36 | 100.0 | 30 | GCGTTTAAAG | .......................... | TTTGGTTGTACCCCTTTTTGAACATATAGG |
| 1591 | 36 | 100.0 | 30 | AACATATAGG | .......................... | TGCGTAATGATCAGGTGGCAGAATCAATGC |
| 1592 | 36 | 100.0 | 30 | GAATCAATGC | .......................... | CATAAAACCTTGATTTTCATAAGATATATC |
| 1593 | 36 | 100.0 | 30 | AAGATATATC | .......................... | CCAATAGTCAATTCTGTTAGCCAGTAGGGA |
| 1594 | 36 | 100.0 | 30 | CCAGTAGGGA | .......................... | TGCTATATAAA |
|  | 35 |  | 30 |  | AATATAAACTACCTCTAAATGTAAGAGGACTATAAC | SEQ ID NO: 1595 | dG = -4.98  dH = -42.90  dS = -122.26  $T_m$ = 77.7 °C

```
                10
     ATTAAAGACTA|    AAA
                CCCCT \
                GGGGA  T       SEQ ID NO: 1596
     TCAATATCA--^    ATG
                30
```

*7: Paludibacter propionicigenes WB4, complete genome*

| | Repeat | %id | Spacer | Left flank | Repeat | Spacer |
|---|---|---|---|---|---|---|
| 1597 | 36 | 97.2 | 29 | GCATGTCCTT | ...T...................... | TATTACTGCTGCAATGCAGATTGGCGTAT |
| 1598 | 36 | 100.0 | 29 | AATGGCGTAT | .......................... | TATTACTGCTGCAATGCAGATTGGCGTAT |
| 1599 | 36 | 100.0 | 30 | ATTGGCGTAT | .......................... | GAAAACGAAAATTATAACTTCAATAAATTC |
| 1600 | 36 | 97.2 | 30 | CAATAAATTC | ............T............. | AGTAAAACCGTACAATGGAGAAGATAACGT |
| 1601 | 36 | 94.4 | 30 | AAGATAACGT | .A...................G.... | AGCGGTGCGGATTTGAGCGATGCGAATTTG |
| 1602 | 36 | 97.2 | 30 | TGCCAATTTG | ............A............. | GAATTAGGATTATGAGTTTATATAGTTTGA |
| 1603 | 36 | 94.4 | 30 | TATAGTTTGA | ............A.......T..... | TAAACATTAAAACAATAAACGGAAGTTCGA |
| 1604 | 36 | 97.2 | 30 | GGAAGTTCGA | .....................T.... | AAAGCAAAAATGAACACAAAACAATTTGAA |
| 1605 | 36 | 94.4 | 30 | ACAATTTGAA | ....T......G.............. | TACAGCAGTAAGCGGAAACACTCAGGCAAT |
| 1606 | 36 | 100.0 | 30 | CTCAGGCAAT | .......................... | GCCGTAAAAAATCCACACAACGATAAGATG |
| 1607 | 36 | 94.4 | 30 | CGATAAGATG | ...T................T..... | CTCTTACTGGCTGGTGCCGGGCTTGCTGCA |

FIG. 42E-1

| SEQ ID NO: | | | | | |
|---|---|---|---|---|---|
| 1608 | 36 | 97.2 | 30 | GCTTGCTGCA | ............................T......... |
| 1609 | 36 | 97.2 | 30 | AGCAGGATAT | ............................T......... |
| 1610 | 36 | 100.0 | 30 | TTGCTTAGTG | ........................................ |
| 1611 | 36 | 91.7 | 30 | TAGCTAACGG | ................T.A.........G....... |
| 1612 | 36 | 94.4 | 30 | ATTATATGAC | ...C...C............................ |
| 1613 | 36 | 97.2 | 30 | ACTATGGAAG | ...................A................ |
| 1614 | 36 | 97.2 | 30 | TACCCCACCA | ............................T...... |
| 1615 | 36 | 97.2 | 30 | TTATAAACTA | ............................T...... |
| 1616 | 36 | 97.2 | 30 | TCAGTAGCTT | ............................T...... |
| 1617 | 36 | 97.2 | 30 | ACTGCTTCAT | ............................T...... |
| 1618 | 36 | 97.2 | 30 | AAGCTCCAGT | ....................A............... |
| 1619 | 36 | 100.0 | 30 | GAACCTGGTA | ........................................ |
| 1620 | 36 | 97.2 | 30 | TCCCTGATAA | ...T.................................. |
| 1621 | 36 | 94.4 | 30 | CAAAGAGTAT | ...T..............A.................. |
| 1622 | 36 | 94.4 | 30 | GAACTAGGGC | ...T..............A.................. |

Right column sequences:
```
AGAAAGAGTGATGAACGACGAGCAGGATAT
TTACACCTGATCAATGGAAATTGCTTAGTG
TGTGATTAATGATATTACCGTAGCTAACGG
AAAACAACCTGCATGGATAAATTATATGAC
TAAAAACATATTTGCTGAAGACTATGGAAG
TGCTATTCGGAATAGATTTTTACCCCACCA
TGGGATTATGAAATAACCGATTATAAACTA
AGAAATCAAAAATTGATTCTTCAGTAGCTT
CGAATCCTAATGGTTATATTACTGCTTCAT
TAAATTGAAAATTTCTGGACAAGCTCCAGT
AAACGAATCACAGAACATGTGAACCTGGTA
AGATGATAACGTAGGCAACATCCCTGATAA
CGTTATTCAGGAGAGTTTCAAAGACTAT
TAAAACATTGGCTAATAACAGAACTAGGGC
ATAGTATCTG
```

| 36 | | 29 | GTTGTAGTTCCCTTCAATTTTGGGATAATCCACAAG | SEQ ID NO: 1623 |

FIG. 42E-2 dG = -1.78  dH = -27.40  dS = -82.61  $T_m$ = 58.5 °C

```
              10
GTTGTAGTT---|     TTCA
            CCC        \
            GGG        A
GAACACCTAATA^     TTTT
            30    20
```
SEQ ID NO: 1624 dG = -0.97  dH = -23.80  dS = -73.61  $T_m$ = 50.2 °C

```
          10        20
GTTGTAGTTCCCTTCAATTTTG|    T
                      GGA    \
                      CCT    A
GAACA-----------------^    A
                      30
```
SEQ ID NO: 1625 dG = -0.82  dH = -43.10  dS = -136.32  $T_m$ = 43.0 °C

```
              10
GTTGTA|------          TTCA
      GT      TCCC         \
      CA      AGGG         A
GAA---^   CCTAAT       TTTT
          30           20
```
SEQ ID NO: 1626

FIG. 42F-1

SEQ 8: *Listeria seeligeri serovar 1/2b str. SLCC3954 complete genome*

| SEQ ID NO: | Repeat | %id | Spacer | Left flank | Repeat | Spacer |
|---|---|---|---|---|---|---|
| 1627 | 36 | 100.0 | 30 | TGTTATTGCA | ............................ | CATATTTCCAAACTCCACTTTGACTACACC |
| 1628 | 36 | 100.0 | 30 | TGACTACACC | ............................ | GGTCCCACTACTTGAGGTACGAACATATCA |
| 1629 | 36 | 100.0 | 30 | GAACATATCA | ............................ | TTAGTCAACCCCTCGCTGCATTTTCACATT |
| 1630 | 36 | 100.0 | 30 | TTTTCACATT | ............................ | GATGGATAATAGGGATAGATCATTAGTCCG |
| 1631 | 36 | 100.0 | 30 | CATTAGTCCG | ............................ | GTCTAATGTG |
|  | 36 |  | 30 |  | GTAAGAGACTACCTCTATATGAAAGAGGACTAAAAC | SEQ ID NO: 1632 |

$dG = -3.88$  $dH = -42.90$  $dS = -125.81$  $T_m = 67.9\ °C$

```
            10
GTAAGAGACTA|      ATA
           CCTCT  \
           GGAGA   T        SEQ ID NO: 1633
  CAAAATCA---^    AAG
           30
```

9: *Listeria weihenstephanensis FSL R9-0317 c4, whole genome shotgun sequence*

Array 1
>gi|738100645|ref|NZ_AODJ01000004.1|:41000-48000 Listeria weihenstephanensis FSL R9-0317 c4, whole genome shotgun sequence

|  | Repeat | %id | Spacer | Left flank | Repeat | Spacer |
|---|---|---|---|---|---|---|
| 1634 | 36 | 97.2 | 30 | TATTTTCATA | ..............G............... | GCACTCTCCGACAATAATCTCGTCCATTTT |
| 1635 | 36 | 100.0 | 30 | CGTCCATTTT | ............................ | AACTCTGTACTTGTGAAGTACGTTAAATCC |
| 1636 | 36 | 100.0 |  | CGTTAAATCC | ............................ | CTCTTTTGTG |
|  | 36 |  | 30 |  | GATTTAGAGTACCTCAAAACAAAAGAGGACTAAAAC | SEQ ID NO: 1637 |

Array 2
>gi|738100645|ref|NZ_AODJ01000004.1|:41000-48000 Listeria weihenstephanensis FSL R9-0317 c4, whole genome shotgun sequence

|  | Repeat | %id | Spacer | Left flank | Repeat | Spacer |
|---|---|---|---|---|---|---|
| 1634 | 36 | 97.2 | 30 | TATTTTCATA | ............................ | GCACTCTCCGACAATAATCTCGTCCATTTT |
| 1635 | 36 | 100.0 | 30 | CGTCCATTTT | ............................ | AACTCTGTACTTGTGAAGTACGTTAAATCC |
| 1636 | 36 | 100.0 | 30 | CGTTAAATCC | ............................ | CTCTTTTGTG |
| 1634 | 36 | 97.2 | 30 | TATTTTCATA | ............................ | GCACTCTCCGACAATAATCTCGTCCATTTT |
| 1635 | 36 | 100.0 | 30 | CGTCCATTTT | ............................ | AACTCTGTACTTGTGAAGTACGTTAAATCC |
| 1636 | 36 | 100.0 | 30 | CGTTAAATCC | ............................ | CTCTTTTGTG |
| 1636 | 36 | 100.0 |  | CGTTAAATCC | ............................ | CTCTTTTGTG |
|  | 36 |  | 30 |  | GATTTAGAGTACCTCAAAACAAAAGAGGACTAAAAC | SEQ ID NO: 1637 |

FIG. 42F-2 dG = -3.00  dH = -35.20  dS = -103.82  T$_m$ = 60.8 °C
```
         10
GATTTAGAGTA|    AAAA
            CCTC   \
            GGAG    C

CAAAATCA---^    AAAA
       30
```
SEQ ID NO: 1646 dG = -2.35  dH = -70.80  dS = -220.70  T$_m$ = 47.6 °C
```
         10
GA|   AGTA   AAAA
  TTTAG   CCTC  \
  AAATC   GGAG   C
CA^    A---    AAAA
  30
```
SEQ ID NO: 1647

*10: Listeria newyorkensis strain FSL M6-0635 contig000012, whole genome shotgun sequence*

| | Repeat | %id | Spacer | Left flank | Repeat | Spacer |
|---|---|---|---|---|---|---|
| 1648 | 36 | 100.0 | 29 | CGTAATGCTT | ................................ | TAACTTGTCGATATGGTATAGCTTTTTTCA |
| 1649 | 36 | 100.0 | 30 | GCTTTTTTCA | ................................ | TAAAGCTTCTAAATGGTGGCGCGTTACGCC |
| 1650 | 36 | 97.2 | 30 | GCGTTACGCC | ......A......................... | CTAGCAAGCCGGTCGCCGCGCTCAAAGTAA |
| 1651 | 36 | 100.0 | | CTCAAAGTAA | ................................ | CTCTTTTGTGG |
| | 36 | | 29 | | GATTTAGAGTACCTCAAAACAAAAGAGGACTAAAAC | SEQ ID NO: 1652 | dG = -3.00  dH = -35.20  dS = -103.82  T$_m$ = 65.9 °C
```
         10
GATTTAGAGTA|    AAAA
            CCTC   \
            GGAG    C

CAAAATCA---^    AAAA
       30
```
SEQ ID NO: 1653 dG = -2.35  dH = -70.80  dS = -220.70  T$_m$ = 47.6 °C
```
         10
GA|   AGTA   AAAA
  TTTAG   CCTC  \
  AAATC   GGAG   C
CA^    A---    AAAA
  30
```
SEQ ID NO: 1654

FIG. 42G-1

SEQ 12:Leptotrichia wadei F0279 Scaffold 804, whole genome shotgun sequence

| SEQ ID NO: | Repeat | %id | Spacer | Left flank | Repeat | Spacer |
|---|---|---|---|---|---|---|
| 1655 | 39 | 100.0 | 29 | ATGATGTATG | .................................. | CTGGTAAACCAATCCACATCGAAGAAAAG |
| 1656 | 39 | 97.4 | 30 | CGAAGAAAAG | A................................. | ATGTAGAAGAAGTTATTGTATCTATTT |
| 1657 | 39 | 97.4 | | GTATCTATTT | .................................. | TTTATATCAA |
| | 39 | | 28 | | TAAGTTTTAGTCCCCTTCGTTTTTGGGGTAGTCTAAATC | SEQ ID NO: 1658 | dG = -3.05  dH = -37.70  dS = -111.72  $T_m$ = 64.3 °C

```
         10
TAAGTTTTAGT|    TTCG
              CCCC    \
              GGGG    T
CTAAATCTGAT^    TTTT
         30
```

SEQ ID NO: 1659 dG = -2.63  dH = -74.10  dS = -230.44  $T_m$ = 48.4 °C

```
      10
TAAGT|  T---   TTCG
   TTTAG  CCCC    \
   AAATC  GGGG    T
 CT---^  TGAT   TTTT
      30
```

SEQ ID NO: 1660

FIG. 42G-2

SEQ 18: Leptotrichia shahii DSM 19757 B031DRAFT_scaffold_9.10, whole genome shotgun sequence

| SEQ ID NO: | Repeat | %id | Spacer | Left flank | Repeat | Spacer |
|---|---|---|---|---|---|---|
| 1661 | 36 | 100.0 | 32 | ATTCTTTAGA | .................................. | GAAAAAGAAGAGTTTATTCAGATAGATTTGTC |
| 1662 | 36 | 100.0 | 31 | TAGATTTGTC | .................................. | AATATGGATTACTTGGTAGAACAGCAATCTA |
| 1663 | 36 | 100.0 | | CAGCAATCTA | .................................. | CCATCCTAATT |
| | 37 | | 31 | | GTTTTAGTCCCCTTCGATATTGGGGTGGTCTATATC | SEQ ID NO: 1664 | dG = -3.05  dH = -37.70  dS = -111.72  $T_m$ = 64.3 °C

```
         10
GTTTTAGT---|   TTCG
              CCCC    \
              GGGG    A
CTATATCTGGT^    TTAT
         30           20
```

SEQ ID NO: 1665

FIG. 42H-1

SEQ ID NO: 19: Rhodobacter capsulatus SB 1003, complete genome

| SEQ ID NO: | Repeat | %id | Spacer | Left flank | Repeat | Spacer |
|---|---|---|---|---|---|---|
| 1666 | 37 | 100.0 | 33 | GAACATCATG | ............................. | TCTCCCAGCATACCAAACCGCTGGCGACCATCA |
| 1667 | 37 | 91.9 | 34 | GCGACCATCA | ............................. | TGCACAGGAGAGACCGATGAAAATCACGGCCTTA |
| 1668 | 37 | 97.3 | 32 | CACGGCCTTC | ............................. | ACCTAAACAAGAGGTTCTACGATGCCGAAAGG |
| 1669 | 37 | 100.0 |    | TGCCGAAAGG | ............................. | TCAGGTCCCGC |
|      | 37 |       | 33 |            | GGTTCAGTCCGCCGTCGTCTTGGCGGTGATGTGAGGC | SEQ ID NO: 1670 | dG = -5.72  dH = -47.70  dS = -135.35  $T_m$ = 79.3 °C

```
                10
GGTTCAGT---|        GTC
               CCGCC    G
               GGCGG    T
CGGAGTGTAGT^        TTC
        30          20
```

SEQ ID NO: 1672 dG = -4.79  dH = -51.70  dS = -151.25  $T_m$ = 68.7 °C

```
              10
GGTT-----| GT      GTC
          CA  CCGCC    G
          GT  GGCGG    T
CGGAGTGTA^ --      TTC
       30          20
```

SEQ ID NO: 1673

SEQ ID NO: 20: Rhodobacter capsulatus R121 seq0019, whole genome shotgun sequence

| SEQ ID NO: | Repeat | %id | Spacer | Left flank | Repeat | Spacer |
|---|---|---|---|---|---|---|
| 1674 | 37 | 100.0 | 33 | GAACATCATG | ............................. | TCTCCCAGCATACCAAACCGCTGGCGACCATCA |
| 1675 | 37 | 91.9 | 34 | GCGACCATCA | ............................. | TGCACAGGAGAGACCGATGAAAATCAACGGCTTC |
| 1676 | 37 | 97.3 | 32 | CAACGGCTTC | .................C........ | ACCTAAACAAGAGGTTCTACGATGCCGAAAGG |
| 1677 | 37 | 100.0 |    | TGCCGAAAGG | ............................. | TCAGGTCCCGC |
|      | 37 |       | 33 |            | GGTTCAGTCCGCCGTCGTCTTGGCGGTGATGTGAGGC | SEQ ID NO: 1678 |

```
           10
GGTTCAGT---|    GTC
        CCGCC  G
        GGCGG  T               SEQ ID NO: 1679
CGGAGTGTAGT^    TTC
     30         20
```

$dG = -4.79$  $dH = -51.70$  $dS = -151.25$  $T_m = 68.7\ °C$

```
           10
GGTT-----| GT      GTC
         CA  CCGCC  G
         GT  GGCGG  T          SEQ ID NO: 1680
CGGAGTGTA^ --     TTC
     30           20
```

$dG = -4.72$  $dH = -37.60$  $dS = -106.01$  $T_m = 81.5\ °C$

```
           10
GGTTCAGTC|      GT
        CGCCGTC  \
        GTGGCGG  C             SEQ ID NO: 1681
CGGAGTGTA^      TT
     30         20
```

FIG. 42I-1

21: RHODOBACTER CAPSULATUS DE442 SEQ0020, WHOLE GENOME SHOTGUN SEQUENCE

| SEQ ID NO: | REPEAT | %ID | SPACER | LEFT FLANK | REPEAT | SPACER |
|---|---|---|---|---|---|---|
| 1682 | 37 | 100.0 | 33 | GAACATCATG | ......... | TCTCCCAGCATACCAAACGCTGGCGACCATCA |
| 1683 | 37 | 91.9 | 34 | GCGACCATCA | ......... | TGCACAGGAGAGACCGATGAAAATCAACGGCTTC |
| 1684 | 37 | 97.3 | 32 | CAACGGCTTC | .....C... | ACCTAAACAGAGGTTCTACGATGCCGAAAGG |
| 1685 | 37 | 100.0 | 32 | TGCCGAAAGG | ......... | TCAGGTCCCGC |
| | 37 | | 33 | | GGTTCAGTCCGCGGTCCGTCGTCTTGGCGGTGATGTGAGGC | SEQ ID NO: 1686 |

```
         10
GGTTCAGT---|    GTC
         CCGCC   G          SEQ ID NO: 1687
         GGCGG   T
CGGAGTGTAGT^    TTC
       30      20
```

$dG = -4.79$ $dH = -51.70$ $dS = -151.25$ $T_m = 68.7\ °C$

```
        10
GGTT-----| GT    GTC
        CA CCGCC   G        SEQ ID NO: 1688
        GT GGCGG   T
CGGAGTGTA^ --    TTC
        30      20
```

$dG = -4.72$ $dH = -37.60$ $dS = -106.01$ $T_m = 81.5\ °C$

```
       10
GGTTCAGTC|     GT
        CGCCGTC  \
        GTGGCGG  C          SEQ ID NO: 1689
CGGAGTGTA^     TT
      30      20
```

FIG. 42I-3

| SEQ ID NO: | NO | SPACER LENGTH | REPEAT LENGTH | REPEAT | SPECIES |
|---|---|---|---|---|---|
| 1690 | 1 | 36 | 35 | GTTCTATTGCCAACTATATCTGGCTTTTCTCAATAC | LACHNOSPIRACEAE BACTERIUM MA2020 T348DRAFT_SCAFFOLD00014.14_C, WHOLE GENOME SHOTGUN SEQUENCE |
| 1691 | 2 | 33 | 35 | GTTATTGCCCCTATCTTGGGCTTCTCATCAAC | LACHNOSPIRACEAE BACTERIUM NK4A179 G621DRAFT_SCAFFOLD00054.54_C, WHOLE GENOME SHOTGUN SEQUENCE |
| 1692 | 3 | 35 | 35 | GTTTGGAGAACAGCCCGATATAGAGGCAATAGAC | [CLOSTRIDIUM] AMINOPHILUM DSM 10710 BR86DRAFT_SCAFFOLD00011.11_C, WHOLE GENOME SHOTGUN SEQUENCE |
| 1693 | 4 | 35 | 35 | GTTTTGAGAATAGCCCGACATAGAGGCAATAGAC | LACHNOSPIRACEAE BACTERIUM NK4A144 G619DRAFT_SCAFFOLD00027.27_C, WHOLE GENOME SHOTGUN SEQUENCE |
| 1694 | 5 | 35 | 35 | GTTATAGTCCCTCTTACATTTAGAGGTAGTCTTTAATT | CARNOBACTERIUM GALLINARUM DSM 4847 STRAIN MT44 BR43DRAFT_SCF7180000000012_QUIVER.5_C, WHOLE GENOME SHOTGUN SEQUENCE |
| 1695 | 6 | 30 | 36 | AATATAAACTACTCTAAAATGTAAGAGACTATAAC | CARNOBACTERIUM GALLINARUM DSM 4847 STRAIN MT44 BR43DRAFT_SCF7180000000012_QUIVER.5_C, WHOLE GENOME SHOTGUN SEQUENCE |
| 1696 | 7 | 30 | 36 | GTTGTAGTTCCCTTCAATTTTGGGATAATCCACAAG | PALUDIBACTER PROPIONICIGENES WB4, COMPLETE GENOME GI|313202490|REF|NC_014734.1| |
| 1697 | 8 | 30 | 36 | GTAAGAGACTACCTCTATATCGAAAGAGGACTAAAAC | LISTERIA SEELIGERI SEROVAR 1/2b STR. SLCC3954 COMPLETE GENOME |
| 1698 | 9 | 30 | 36 | GATTTAGAGTACTCAAAACAAAAGAGGACTAAAAC | LISTERIA WEIHENSTEPHANENSIS FSL R9-0317 C4, WHOLE GENOME SHOTGUN SEQUENCE |
| 1699 | 10 | 29 | 36 | GATTTAGAGTACTCAAAACAAAAGAGGACTAAAAC | LISTERIA NEWYORKENSIS STRAIN FSL M6-0635 CONTIG000012, WHOLE GENOME SHOTGUN SEQUENCE |
| 1700 | 12 | 28 | 39 | TAAGTTTTAGTCCCCTTCGTTTTCGTTTTGGGTAGTCTAAATC | LEPTOTRICHIA WADEI F0279 SCAFFOLD804, WHOLE GENOME SHOTGUN SEQUENCE |
| 1701 | 18 | 31 | 36 | GTTTTAGTCCCCTTCGATATTGGGGTGGCTCTATATC | LEPTOTRICHIA SHAHII DSM 19757 B031DRAFT_SCAFFOLD_9.10, WHOLE GENOME SHOTGUN SEQUENCE |
| 1702 | 19 | 33 | 37 | GGTTCAGTCCGCCGTCGTCTTGGCGGTGATGTGAGGC | RHODOBACTER CAPSULATUS SB 1003, COMPLETE GENOME |
| 1703 | 20 | 33 | 37 | GGTTCAGTCCGCCGTCGTCTTGGCGGTGATGTGAGGC | RHODOBACTER CAPSULATUS R121 SEQ0019, WHOLE GENOME SHOTGUN SEQUENCE |
| 1704 | 21 | 33 | 37 | GGTTCAGTCCGCCGTCTTGGCGGTGATGTGAGGC | RHODOBACTER CAPSULATUS DE442 SEQ0020, WHOLE GENOME SHOTGUN SEQUENCE |

FIG. 42J-1

| SEQ ID NO: | ID | INPUT | STRUCTURES | SEQUENCES | SUPERCLASS | CAS SUBTYPE |
|---|---|---|---|---|---|---|
| 1705 | 1 | GTCTATTGCCAACTATATCTGGCTTTTCTCAATAC | - | - | C | - |
| 1706 | 2 | GTTATTGCCCTCTATCTTGGGCTCTTCTCATCAAC | - | - | C | - |
| 1707 | 3 | GTTTGGAGAACAGCCCGATATATAGAGGGCAATAGAC | - | - | E | III-B |
| 1708 | 4 | GTTTTGAGAATAGCCCGACATAGAGGGCAATAGAC | - | - | E | III-B |
| 1709 | 5 | GTTATAGTCCTCTTACATTTAGAGGTAGTCTTTAATT | - | - | - | II-C |
| 1710 | 6 | AATATAAACTACCTCTAAATGTAAGAGGACTATAAC | - | - | F | II-C |
| 1711 | 7 | GTTGTAGTTCCCTTCAATTTTGGGATAATCCACAAG | - | - | F | II-C |
| 1712 | 8 | GTAAGAGACTACCTCTATATGAAAGAGGACTAAAAC | - | FAMILY 24 | F | II-C |
| 1713 | 9 | GATTTAGAGTACCTCAAAACAAAGAGGACTAAAAC | - | - | F | II-C |
| 1714 | 10 | GATTTAGAGTACCTCAAAACAAAGAGGACTAAAAC | - | - | F | II-C |
| 1715 | 12 | TAAGTTTTAGTCCCCTTCGTTTTTGGGGTAGTCTAAATC | - | - | - | II-C |
| 1716 | 18 | GTTTTAGTCCCTTCGATATTGGGGTGGTCTATATC | - | - | F | II-C |
| 1717 | 19 | GGTTCAGTCCCCGTCGTCTTGGCGGTGATGTGAGGC | - | - | F | I-B |
| 1718 | 20 | GGTTCAGTCCGCGTCGTCTTGGCGGTGATGTGAGGC | - | - | F | I-B |
| 1719 | 21 | GGTTCAGTCCGCGTCTTGGCGGTGATGTGAGGC | - | - | D | - |

FIG. 42J-2

| SEQ ID NOs: | LOCUS NO | ARRAY NO | NORMAL REPEAT | SPACER | DOWNSTREAM |
|---|---|---|---|---|---|
| 1720 1736 1752 | 1 | 1 | GTATTGAGAAAAGCCAGAT ATAGTTGGCAATAGTC | ATTTCTTCTCTT GTCATTCTTCTA CCTTTTCGCCACAA | GTATTGAGAAAAGCCAGATATAGCATGAACACTTCGGTGTTTGTGCT TTTTTAGTATGACGGGCATGCCGTCAGTCTGTGGTGAAAGTCCACAA GGGGCGTAGTTGCCAACGACCCCAAAGCAACTCCCAAGGTTTACA CCGTGAGGGTGAGGGCGAGAAGAAGGGATAGCAAAATCGTAGCCTG ACGAACAGAAACCTG |
| 1721 1737 1753 | 5 | 1 | ATTAAAGACTACCTCTAAAT GTAAGAGGACTATAAC | TTTTCCATTTTCC CACTACTTTCTA AAAAGA | ATTAAAGACTACCTCTAAATGTAAGAAAATAAAAAATAAAGAG TTACATATAGTTAAGAAAAGAGTAGGAATATTTATTCCTACTTCTT TTTCGTTGTTATTTAATTTATTTATATGAATATGATAGATAGATAT ATAGTATTAGAATGAGGGTATTGTTAAGATGCGTATAACAAAGT GAAAATAAAATT |
| 1722 1738 1754 | 5 | 1 | GTTATAGTCCCTCTTACATTT AGAGGTAGTCTTTAAAT | TGATTATATCG AAAATCAAATA AATGCGCT | GTTATAGTCCCTCTTACATTTAGAGGTTGGAATGGCAACAGTTTTTTG ACAAATTTTATAAGGTGCAGAACTTCTTTCCGTATGCTATTCCGATTG TCCTTGACAATGAGCCTCCGGATGTGACCATCTTCGGCAGGAGCT AACAGTTAAAGTTAGACTGCCTCGCTAGCGTTAGCACATCCGAGCTC ATTATCAAGG |
| 1723 1739 1755 | 6 | 2 | ATTAAAGACTACCTCTAAAT GTAAGAGGACTATAAC | CGTTTATTGGTC AGAGTAAACTC AACTCCG | ATTAAAGACTACCTGGATAGGCTACAATTAACTAGACAGAAAAATTA AGGTGTGTAGACTAGAAGAAAAACATACCAGGAGGAATTTTTATGTC TAAGAGAACACGAAGACTTTTTCACAAGAATTCAAGCAACAAATC GTCAATCTTTACTTAGCTGGAAAGCCACGTGTAGAAATCATTCGAGA ATATGAACTAACGG |

FIG. 42K-1

| SEQ ID NOs: | | | | |
|---|---|---|---|---|
| 1724<br>1740<br>1756 | 9 | 1 | GTTTTAGTCCTCTTCTGTTTT<br>GAGGTACTCTAAATC | TATGAAAATAA<br>TGTAACACCAA<br>TCGTTTGG | GTTTTAGTCCTCTTCTGTTTTGAGGTAATATATCGGCTATTCGCTTG<br>CAACAACATAACTATACCAGATTATTAATGAATCTGCAGCTTGACAG<br>ATTAGCAAAACATAATATATTTTTCATAAATTAAGACAGCTCAGC |
| | | | | | AGCCATCTCTTAAATTCAACCAATTATCTTCTGCTAACAAAATACCTT<br>CCTTCTTGAA |
| 1725<br>1741<br>1757 | 9 | 2 | GTTTTAGCCCTCTTTTGTTGT<br>GAGGTACTCTAAATC | ATATATTTTTGTA<br>ACGGCTTGCAA<br>TCATTT | GTTTTAGTCCTCTTGTTTGAGGTATTTTTTAATAGCAAAATGAAA<br>TTGCATTCTCCATCCAATTTCATTTTGAAATTAACTGCAACATTCTAT<br>AICAAATTCTAATAGTCTCTTTACTATACCACAATACTCTTCTGAAAC<br>TTGATTTGTTTCTATATAACCATTATCGATTTTTTTCTCACCTAGATGT<br>CTCAA |
| 1726<br>1742<br>1758 | 4 | 1 | GTTTTGAGAATAGCCCGAC<br>ATAGAGGGCAATAGAC | TTCTTCTCTTGT<br>CATTCTTCTACC<br>TCTAAAATCTCA | GTTTTGAGAATAGCCCGACATAGTTGAAGTCAGTGTTTATCGGTTTTTGT<br>GATAAACATTGACTAATTGTTGAAGTCAGTGTTTATCGGTTTTTTGT<br>GTAAATATAGGAGTTGTTAGAATGATACTTTTTGCCTAATTTGGAA<br>CTTTATGAGGATATAAGATAGACTTGATAAAAAGGTAAAAGAAAG<br>TTAAAGAGCATG |
| 1727<br>1743<br>1759 | 3 | 1 | GTTTGGAGAACAGCCCGAT<br>ATAGAGGGCAATAGAC | GGTGTACTTGT<br>TCCACTCAATCC<br>ACTTATCATCTT | GTTTGAGAACAGCCTGATATAGAGGGCGATAGGACTTTGGCTGCA<br>TGACTCGATCATTAAGCCTGAAACTAAGTTTTCTTGTTGAAATCTT<br>CCTAATACTGAGGTCGTAAGACCATCTTGATTATTCACCAATCTGTG<br>ACTCGTTCTCGAGAACATCATACTATAAGGACAATGTTTTTGAA<br>ATGGAGGATTT |

FIG. 42K-2

| SEQ ID NOs: | | | | |
|---|---|---|---|---|
| 1728<br>1744<br>1760 | 21 | 1 | TCACATCACCGCCAAGACG<br>ACGGCCGGACTGAACC | CATGATGTTCCT<br>TTCTTGGGTAT<br>GGGGTAAGCC | TCACATCACCGCCAAGATGACGGCGGGAACCCAATGCAAACGGAG<br>GTGCGCAACAGCAAGGTTGCACGGCTGGACTTCGGCGGCCAGTCT<br>GGCCCAACGGGGCGCAGACACGGAAGATGTGGCGGGGGCAAGA<br>TGGACCTGTTTTTCAAGGCCACGGAATATGAGACCCTGCAGGCCTCA<br>TGCCTCAAGGTCCAGCAA |
| 1729<br>1745<br>1761 | 20 | 1 | TCACATCACCGCCAAGACG<br>ACGGCCGGACTGAACC | CATGATGTTCCT<br>TTCTTGGGTAT<br>GGGGTAAGCC | TCACATCACCGCCAAGATGACGGCGGGAACCCAATGCAAACGGAG<br>GTGCGCAACAGCAAGGTTGCACGGCTGGACTTCGGCGGCCAGTCT<br>GGCCCAACGGGGCGCAGACACGGAAGATGTGGCGGGGGCAAGA<br>TGGACCTGTTTTTCAAGGCCACGGAATATGAGACCCTGCAGGCCTCA<br>TGCCTCAAGGTCCAGCAA |
| 1730<br>1746<br>1762 | 19 | 1 | TCACATCACCGCCAAGACG<br>ACGGCCGGACTGAACC | CATGATGTTCCT<br>TTCTTGGGTAT<br>GGGGTAAGCC | TCACATCACCGCCAAGATGACGGCGGGAACCCAATGCAAACGGAG<br>GTGCGCAACAGCAAGGTTGCACGGCTGGACTTCGGCGGCCAGTCT<br>GGCCCAACGGGGCGCAGACACGGAAGATGTGGCGGGGGCAAGA<br>TGGACCTGTTTTTCAAGGCCACGGAATATGAGACCCTGCAGGCCTCA<br>TGCCTCAAGGTCCAGCAA |

FIG. 42K-3

| SEQ ID NOs: | | | | |
|---|---|---|---|---|
| 1731 1747 1763 | 2 | 2 | GCTGGGAAGAGATAGCCCAA GAAAGAGGGCAATAAC | GCTAACATCTCC GGTGTTATTAC CACTCCATTCT | GTTGGAGAAGAGAGCCCAGATAGAGGAGATTGACATTTATTACAA GCGGAGATTAAACGATACTGAGAAAAAATGAATAACGCTGATGA AAACGGCCGGATTCTTGGCCGTTTTTTTGTCTATTTGCTAAGTCCACA AAGATTGTGAAATAACATCTGTACTATGTATTTATCGAGGTAGTA AATCTAGGTGGTG |
| 1732 1748 1764 | 10 | 1 | GTTTTAGTCCTCTTTTTGTTTT GAGGTACTCTAAATC | AAGCATTACGG CGTATCACGGC ACCAATTA | GTTTTAGTCCTCTTTATTTGAGGTAATATATTCACTTGCAACAACA TAACTATACCAGATTATTAATCGATCTGACATCTTGACAGATTACCAA AACATAATAATTATTTTTCATAAATTAAGAGACAACTCAGAATACAGAA TTGCCCTCTACATGTCTAATTTTCCCACTGTCTCAATTCCTCTCGCCATAAT ATCTCCACC |
| 1733 1749 1765 | 18 | 1 | GATATAGACCACCCCAATAT CGAAGGGACTAAAAC | TCTAAAGAATT ATCTATTCTGTC TTTTAAATT | GATATAGACCACCCCAATATCGAAAAGTGATATTTAATAAAAATAAC TTCTGAGTGAGAATAAAATTCAATTCTTGCTCATTTTTATTGTTTT TGAATATGGTTGCTTGGTTGTCTGAAACAATAAGAATTATACTATAATAAT TTTAAATTTTTAGGTTGAAAAAAATAAGAATTATACTATAATAAAT AATTATGCGA |
| 1734 1750 1766 | 7 | 1 | TGGATTATCCCAAAATTGAA GGGAACTA | AAACAAGGACA TGCACATACCC ACATGTTTTCT CTTG | TGGATTATCCCAAAATTGAAGGGTAACACTACAGCTGACATCAAAG CACAAAACCCGGAATGAATTCATCATTCGGGGTTGTTTTTATAA AGGTAGCTTAGCTAATGCACTCCTACAGCAAATCACTACTTCTTCA AACGCAATATCTCCGGATTTTCTGCAATAAATTTATTGGCAGCTTCGT AGCCCTGATGATAGATAGTGAAGTAAGAGTCGTAGCTAAACTTCATG AAAGGTTTCGATGGC |
| 1735 1751 1767 | 8 | 1 | GTTTTAGTCCTCTTTCATAT AGAGGTAGTCTCTTAC | TGCAATAACATT TTCTGATACTTT TGGCCG | GTTTTAGTCCTCTTTCATTTACAGGTATATCGTATTCCTACTTAATAAT AGTAATTAAAACACCAATGTAAGGATATAATCAATATATTTAAAG TTTGCACGAGAATGCAATCATTTATTCATAAATATCATAATCATTTAT AAGCTCTATTTTCCATTTCTAAGGCTAATAAATAAAACTGCTGTACC TATGGATCTAAGGAAGACTTATGCACACAGTACGCAACTTTCAGC ATGATTGTGT |

NOTE: 5TH LOCUS HAS MULTIPLE SUBSTITUTIONS IN SEVERAL REPEATS AT THE END OF THE ARRAY. IN THIS CASE ALL THESE VARIANTS ARE SHOWN SEPARATELY IN THE TABLE.

FIG. 42L

| LOCUS NO | LOCUS STRUCTURE* | SPECIES NAME AND LINK TO NCBI GENOME VIEWER |
|---|---|---|
| 1 | <casCandidate<--<cas1<--CRISPR | GUT METAGENOME CONTIG-6000335, WHOLE GENOME SHOTGUN SEQUENCE gb\|AUXO013399408.1 http://www.ncbi.nlm.nih.gov/projects/sviewer/?id=AUXO013399408.1 |
| 2 | >unk>-->casCandidate>-->cas1>--CRISPR | GUT METAGENOME CONTIG-6000335, WHOLE GENOME SHOTGUN SEQUENCE gb\|AUXO013399408.1 http://www.ncbi.nlm.nih.gov/projects/sviewer/?id=AUXO013399408.1 |
| 3 | >cas1>--<casCandidate< | MARINE METAGENOME GENOME ASSEMBLY TARA_137_DCM_0.22-3, CONTIG TARA_137_DCM_0.22-3_SCAFFOLD242249_1, WHOLE GENOME SHOTGUN SEQUENCE gi\|843463465\|emb\|CEUC011470054.1\| http://www.ncbi.nlm.nih.gov/projects/sviewer/?id=CEUC011470054.1 |
| 4 | >casCandidate>--<cas1< | MARINE METAGENOME GENOME ASSEMBLY TARA_039_MES_0.22-1.6, CONTIG TARA_039_MES_0.22-1.6_C8247301_1, WHOLE GENOME SHOTGUN SEQUENCE emb\|CEPV01213247.1 http://www.ncbi.nlm.nih.gov/projects/sviewer/?id=CEPV01213247.1 |
| 5 | >casCandidate>--<cas1< | MARINE METAGENOME GENOME ASSEMBLY TARA_037_MES_0.22-1.6, CONTIG TARA_037_MES_0.22-1.6_SCAFFOLD260484_1, WHOLE GENOME SHOTGUN SEQUENCE gi\|841630493\|emb\|CEQE01148443.1\| http://www.ncbi.nlm.nih.gov/projects/sviewer/?id=CEQE01148443.1 |
| 6 | <casCandidate<--<cas1<--[D]CRISPR | MARINE METAGENOME GENOME ASSEMBLY TARA_037_MES_0.1-0.22, CONTIG TARA_037_MES_0.1-0.22_C20643590_1, WHOLE GENOME SHOTGUN SEQUENCE gi\|859280137\|emb\|CEPX01406412.1\| http://www.ncbi.nlm.nih.gov/projects/sviewer/?id=CEPX01406412.1 |
| 7 | >cas1>--<casCandidate< | MARINE METAGENOME GENOME ASSEMBLY TARA_137_MES_0.22-3, CONTIG TARA_137_MES_0.22-3_C218155641_1, WHOLE GENOME SHOTGUN SEQUENCE gi\|84558300\|emb\|CEUD01312811.1\| http://www.ncbi.nlm.nih.gov/projects/sviewer/?id=CEUD01312811.1 |
| 8 | <casCandidate<--<cas1<--CRISPR | MARINE METAGENOME GENOME ASSEMBLY TARA_125_SRF_0.45-0.8, CONTIG TARA_125_SRF_0.45-0.8_SCAFFOLD380077_1, WHOLE GENOME SHOTGUN SEQUENCE gi\|869978290\|emb\|CEVA01225781.1\| |

FIG. 43A

| | | |
|---|---|---|
| 9 | >cas1>-<casCandidate< | http://www.ncbi.nlm.nih.gov/projects/sviewer/?id=CEVA01225781.1 |
| 10 | >cas1>-<casCandidate< | MARINE METAGENOME GENOME ASSEMBLY TARA_124_MIX_0.45-0.8, CONTIG TARA_124_MIX_0.45-0.8_SCAFFOLD280705_1, WHOLE GENOME SHOTGUN SEQUENCE gi\|863357813\|emb\|CEUNO01178856.1\| http://www.ncbi.nlm.nih.gov/projects/sviewer/?id=CEUNO01178856.1 |
| 11 | >cas1>-<casCandidate> | MARINE METAGENOME GENOME ASSEMBLY TARA_137_DCM_0.22-3, CONTIG TARA_137_DCM_0.22-3_C14137931_1, WHOLE GENOME SHOTGUN SEQUENCE gi\|84301408\|emb\|CEUC01309111.1\| http://www.ncbi.nlm.nih.gov/projects/sviewer/?id=CEUC01309111.1 |
| 12 | >cas1>-<casCandidate< | MARINE METAGENOME GENOME ASSEMBLY TARA_124_MIX_0.22-3, CONTIG TARA_124_MIX_0.22-3_C18007371_1, WHOLE GENOME SHOTGUN SEQUENCE gi\|867324807\|emb\|CEUQ01470308.1\| http://www.ncbi.nlm.nih.gov/projects/sviewer/?id=CEUQ01470308.1 |
| 13 | >casCandidate>-<cas1< | MARINE METAGENOME GENOME ASSEMBLY TARA_138_MES_0.22-3, CONTIG TARA_138_MES_0.22-3_SCAFFOLD249784_1, WHOLE GENOME SHOTGUN SEQUENCE gi\|840731506\|emb\|CETX01144758.1\| http://www.ncbi.nlm.nih.gov/projects/sviewer/?id=CETX01144758.1 |
| 14 | >cas1>-<casCandidate< | MARINE METAGENOME GENOME ASSEMBLY TARA_138_MES_0.22-3, CONTIG TARA_138_MES_0.22-3_SCAFFOLD136099_1, WHOLE GENOME SHOTGUN SEQUENCE gi\|840849085\|emb\|CETX01060852.1\| http://www.ncbi.nlm.nih.gov/projects/sviewer/?id=CETX01060852.1 MARINE METAGENOME GENOME ASSEMBLY TARA_124_MIX_0.22-0.45, CONTIG TARA_124_MIX_0.22-0.45_C15973443_1, WHOLE GENOME SHOTGUN SEQUENCE gi\|854156728\|emb\|CEUL01348454.1\| http://www.ncbi.nlm.nih.gov/projects/sviewer/?id=CEUL01348454.1 |

FIG. 43B

| SEQ ID NOs: | | | | |
|---|---|---|---|---|
| | \multicolumn{4}{l}{1: GUT METAGENOME CONTIG-6000335, WHOLE GENOME SHOTGUN SEQUENCE} |
| 1776, 1777 | 7422 | CCCATAATTGATAGGATCTATGAGGT | CTCCCGAAAAGCCTTGT | 7464 |
| 1778, 1779 | 7465 | CCCATGATTGATAGGATCTATGAGGT | TTTCCCCCGACAGGCGTA | 7508 |
| 1780, 1781 | 7509 | CCCATAATTGATAGGATCTATGAGGT | TCCATATGAATGGCGCG | 7551 |
| 1782, 1783 | 7552 | CCCATAATTGATAGGATCTATGAGGT | TGCCGCCGTCCTGCATG | 7594 |
| 1784, 1785 | 7595 | CCCATAATTGATAGGATCTATGAGGT | GCCCGGACCACATGCAC | 7637 |
| 1786, 1787 | 7638 | CCCATAATTGATAGGATCTATGAGGT | AAATATAAATACATTAA | 7680 |
| 1788, 1789 | 7681 | CCCATAATTGATAGGATCTATGAGGT | ATCGGTTATACAGGCTA | 7723 |
| 1790, 1791 | 7724 | CCCATAATTGATAGGATCTATGAGGA | ACGGCGCCGGAAAACAT | 7766 |
| 1792, 1793 | 7767 | CCCATAATTGATAGGATCTATGAGGC | AGAGCCGCGCCTATTGG | 7809 |
| 1794, 1795 | 7810 | CCCATAATTGATAGGATCTATGAGGT | AAAACGGTCCCACTAAT | 7852 |
| 1796, 1797 | 7853 | CCCATAATTGATAGGATCTATGAGGT | AAAACGGTCCCACTAAT | 7895 |
| 1798, 1799 | 7896 | CCCATAATTGATAGGATCTATGAGGT | TGAGCTGCTGGCCCGCA | 7938 |
| 1800, 1801 | 7939 | CCCATAATTGATAGGATCTATGAGGA | TGGTTCCAATGCAGTAA | 7981 |
| 1802, 1803 | 7982 | CCCATAATTGATAGGATCTATGAGGT | ACCTATAACGGCACCTA | 8024 |
| 1804 | 8025 | CCCATAATTGATAGGATCTATGAGGC | | 8050 |

STRUCTURE 1 FOLDING BASES 1 TO 26 OF 15AUG11-18-39-10-983944f048 dG = -0.31 dH = -22.70 dS = -72.19 $T_m$ = 41.3 °C

1805
```
              10
CCCATAATTG|    G
          ATAG \
          TATC  A
TGGAG-----^    T
              20
```

STRUCTURE 2 FOLDING BASES 1 TO 26 OF 15AUG11-18-39-10-983944f048 dG = -0.15 dH = -30.30 dS = -97.21 $T_m$ = 38.5 °C

1806
```
        10
CC--|  ATTGA
    CATA    T
    GTAT    A
TGGA^  CTAGG
        20
```

SPACER HITS INTO VIRUSES

1807  FULL MATCH FOR SPACER: TTGCCGCCGTCCTGCATG
HITS INTO:
585522..586922    CITROBACTER_KOSERI    673531252
HIT INTO PHAGE RELATED DNA HELICASE IN PHAGE RELATED GENE LOCI
2147360..2148667    EDWARDSIELLA_ICTALURI_93-146    409033099
HIT INTO PHAGE RELATED DNA HELICASE IN PHAGE RELATED GENE LOCI
2496712..2498112    ENTEROBACTER_CLOACAE_SUBSP._CLOACAE_NCTC_9394    295095013
HIT INTO PHAGE RELATED DNA HELICASE IN PHAGE RELATED GENE LOCI

FIG. 43C

| SEQ ID NOs: | 6: MARINE METAGENOME GENOME ASSEMBLY TARA_037_MES_0.1-0.22 | | | |
|---|---|---|---|---|
| 1808, 1809 | 1846 | CACGTAGTTTTGAAGGGAAGTTAGAGG | ACCGAATATGAGAACTG | 1889 |
| 1810, 1811 | 1890 | ATCGTAGTTTTGAAGGGAAGTTAGAGG | TACAAATAAACATCAAG | 1934 |
| 1812, 1813 | 1935 | TCGTAGTTTTGAAGGGAAGTTAGAGG | CCGCTCCGGCCGTGAT | 1975 |
| 1814 | 1976 | ATCGTAGTTTTGAAGGGAAGTTAGAGG | | |

STRUCTURE 1 FOLDING BASES 1 TO 27 OF 15AUG11-17-48-41-7593efbee5
dG = 1.43 dH = -12.30 dS = -44.27 $T_m$ = 4.7 °C

```
                  A-------------| GTA
                                TC  G
      1815                      AG  T
            GGAGATTGAAGGGA^ TTT
                 20       10
```

STRUCTURE 2 FOLDING BASES 1 TO 27 OF 15AUG11-17-48-41-7593efbee5
dG = 1.46 dH = -13.50 dS = -48.23 $T_m$ = 6.7 °C

```
                  A------------- |TA
                                TCG  G
      1816                      AGT  T
            GGAGATTGAAGGGA  ^TT
                 20       10
```

| | 8: MARINE METAGENOME GENOME ASSEMBLY TARA_125_SRF_0.45-0.8 | | | |
|---|---|---|---|---|
| 1817, 1818 | 2017 | GTTAGAATTGAGAGGATGTTGAAGGA | TTACACGGCCTATGGTC | 2059 |
| 1819, 1820 | 2060 | GTTAGAATTGAGAGGATGTTGAAGGT | CTTATGCACAACCCTTT | 2102 |
| 1821, 1822 | 2103 | GTTAGAATTGAGAGGATGTTGAAGGA | AACTGAACGGCTTGTTT | 2145 |
| 1823, 1824 | 2146 | GTTAGAATTGAGAGGATGTTGAAGGA | TCTTACTAATTTGCCGA | 2188 |
| 1825 | 2189 | GTTAGAATTGAGAGGATGTTGAAGGA | | 2214 |

FIG. 43D-1

STRUCTURE 1 FOLDING BASES 1 TO 26 OF 15AUG11-18-10-49-af41091c0f
dG = 1.30 dH = -7.90 dS = -29.66 T$_m$ = -6.8 °C

```
                10
      GTTAGA---| GA
SEQ ID       ATT  \
NO: 1826      TAG  G
      AGGAAGTTG^ GA
            20
```

STRUCTURE 2 FOLDING BASES 1 TO 26 OF 15AUG11-18-10-49-af41091c0f
dG = 1.83 dH = -11.90 dS = -44.27 T$_m$ = -4.3 °C

```
                10
      GTTAG-| TTGAG
SEQ ID      AA    \
NO: 1827    TT     A
      AGGAAG^ GTAGG
            20
```

SEQ ID NO: 1828

SPACERS HITS INTO VIRUSES
FULL MATCH FOR SPACER: AACTGAACGGCTTGTTT
HIT INTO:
5400470..5401543  PANDORAEA_PULMONICOLA  743677147
PHAGE RELATED PROTEIN

FIG. 43D-2

| SEQ ID NO: | NO | SPACER LENGTH | REPEAT LENGTH | REPEAT | SPECIES |
|---|---|---|---|---|---|
| 1829 | 1 | 17 | 25 | CCCATAATTGATAGGATCTATGAGGT | GUT METAGENOME contig-6000335, WHOLE GENOME SHOTGUN SEQUENCE gb\|AUXO013399408.1\| |
| 1830 | 6 | 18 | 26 | ATCGTAGTTTTGAAGGGAAGTTAGAGG | MARINE METAGENOME GENOME ASSEMBLY TARA_037_MES_0.1-0.22, contig TARA_037_MES_0.1-0.22_C20643590_1, WHOLE GENOME SHOTGUN SEQUENCE gi\|859280137\|emb\|CEPX01406412.1\| |
| 1831 | 8 | 17 | 25 | GTTAGAATTGAGAGGATGTTGAAGGA | MARINE METAGENOME GENOME ASSEMBLY TARA_125_SRF_0.45-0.8, contig TARA_125_SRF_0.45-0.8_scaffold380071_1, WHOLE GENOME SHOTGUN SEQUENCE gi\|869978290\|emb\|CEVA01225781.1\| |

| | ID | INPUT | STRUCTURES | SEQUENCES | SUPERCLASS | cas SUBTYPE |
|---|---|---|---|---|---|---|
| 1832 | 1 | CCCATAATTGATAGGATCTATGAGGT | motif 11 | . | . | . |
| 1833 | 2 | ATCGTAGTTTTGAAGGGAAGTTAGAGG | motif 11 | . | . | . |
| 1834 | 3 | GTTAGAATTGAGAGGATGTTGAAGGA | . | . | . | . |

FIG. 43E

| | LOCUS NO | ARRAY NO | NORMAL REPEAT | SPACER | DOWNSTREAM |
|---|---|---|---|---|---|
| 1835 1836 1837 | 5 | 1 | CCTCTAACTTCCCTTCAAAACTAGGAT | CAGTTCTCATATTCGGT | CCTCTAACTTCCCTTCAAAACTAGGTGACAAAGGTTAACATATTGTAA TTCCACTTGATTTTGTCATACCAGGGAGAAAATTGGCATGGAAATGG ATCAATTTCAGCACCCCGATTCGGTTTGGACATGGAAATCTAACCAA CGGGGCCGCAAGGCAAGTCTGTGGATTCCCTACCTCGATCAAATAA GAAAAATTAAGGGGACTCGCTGGGAATTTGTTTATAA |

FIG. 43F

| GENOME OR CONTIG | COORDINATES OF AN ORF OR CRISPR ARRAY | Cas GENE OR BRIEF DESCRIPTION OF OTHER PROTEIN CODING GENE | CRISPR-Cas SUBTYPE | CRISPR SEQUENCE |
|---|---|---|---|---|
| C2c1 FAMILY | | | | |
| Alicyclobacillus_contaminans_DSM_17975_G463DRAFT_scaffold00017 | | | | |
| | 2..2656 | c2c1 | SUBTYPE V-B | |
| | 2838..4499 | cas4 | | |
| | 4519..4800 | cas2 | | |
| Desulfovibrio_inopinatus_DSM_10 | | | | |
| | 249012..252461 | c2c1 | SUBTYPE V-B | |
| | 252700..254415 | cas4 | | |
| Desulfonatronum_thiodismutans_s | | | | |
| | 85067..88651 | c2c1 | SUBTYPE V-B | SEQ ID NO: 1838 |
| | 89016..89274 | CRISP | | GTCTCGGCAAGCTTGGTCAGTGTTGGGTGATTGGCAC |
| Opitutaceae_bacterium_TAV5 | | | | |
| | 725574..727233 | CRISP | | CCGCCTGACGATTCGTGAAACGGCATTCGCTGCGGC |
| | 725895..726275 | - | | |
| | 726293..726430 | - | | SEQ ID NO: 1839 |
| | 727553..727849 | cas2 | | |
| | 727855..728958 | cas1 | | |
| | 729046..729690 | - | | |
| | 729757..733923 | c2c1 | SUBTYPE V-B | SEQ ID NO: 1840 |
| | 5097514..5101659 | CRISP | | CTTCAACGAAGCCACGCCGCGAACGGCGTGGAGTG |
| | 5098303..5098812 | - | | |
| | 5098821..5099087 | - | | |
| | 5101766..5105714 | CRISP | | GCTTCAACGAAGCCACGCCGCGAACGGCGTGGAGTG |
| | 5102056..5102184 | - | | |
| | 5103826..5104119 | - | | SEQ ID NO: 1841 |
| | 5104358..5104660 | - | | |
| | 5105972..5106262 | cas2 | SUBTYPE I-U | |
| | 5106435..5108405 | cas4 | | |
| | 5108591..5110372 | PREDICTED PROTEIN OF COG4715 | | |
| | 5116573..5117535 | cas8u1 | SUBTYPE I-U | |
| | 5117528..5120596 | cas3 | | |
| | 5120847..5121644 | PREDICTED PROTEIN OF COG0338 | | |
| | 7084081..7084944 | cas4 | | |
| Tuberibacillus_calidus_DSM_17572_H532DRAFT_scaffold00011.11 | | | | |
| | 33148..33444 | cas2 | | |
| | 33521..35170 | cas4 | | |
| | 35160..38558 | c2c1 | SUBTYPE V-B | |
| Bacillus_thermoamylovorans_strain_B4166_NODE_401 | | | | |
| | 13117..16443 | c2c1 | SUBTYPE V-B | |
| | 16580..18262 | cas4 | | |
| | 18259..18588 | cas2 | | |
| | 18962..21684 | CRISP | | GTCCAAGAAAAAAGAAATGATACGAGGCATTAGCAC |

FIG. 44A        SEQ ID NO: 1842

| Organism | Coordinates | Gene | Subtype | Sequence | SEQ ID NO |
|---|---|---|---|---|---|
| Brevibacillus_sp._CF112_PMI08_contig_61.81 | 10972..13566 | c2c1 | SUBTYPE V-B | | |
| | 13654..15258 | cas4 | | | |
| | 15262..15561 | cas2 | | | |
| Bacillus_sp._NSP2.1_scaffold00005 | 313049..313962 | CRISP | SUBTYPE V-B | GTGCTAACCACGAAGCTTTCCACTAAGCTTTCGAAC | 1843 |
| | 314316..314615 | cas2 | | | |
| | 314619..316223 | cas4 | | | |
| | 316311..319637 | c2c1 | | GTGCTAACCACGAAGCTTTCCACTAAGCTTTCGAAC | 1844 |
| | 320252..320874 | CRISP | | | |
| | 320885..322267 | - | | | |
| | 322323..323219 | - | | GTGCTAACCACGAAGCTTTCCACTAAGCTTTCGAAC | 1845 |
| | 323336..324318 | CRISP | | | |
| Desulfatirhabdium_butyrativorans_DSM_18734_G492DRAFT_scaffold0 | 30671..30855 | CRISP | | GTGTCAGTCGATCAAGCTGTTTTCACCATCGGAACCCC | 1846 |
| | 31252..35721 | - | | | |
| Brevibacillus_agri_BAB- | 1070..1369 | cas2 | | | |
| | 1373..2827 | cas4 | | | |
| | 3064..4551 | c2c1 | SUBTYPE V-B | | 1847 |
| | 4635..6389 | c2c1 | | | |
| | 7004..9304 | CRISP | | GTGCTAATCCCGAAGCTTTCCACTAAGCTTTCGAAC | 1848 |
| Methylobacterium_nodulans_ORS_ | 623501..623960 | CRISP | | GTGCCAACGCGCTCAGGATCTGGCGCCCACTGCGAC | |
| | 624239..626215 | c2c1 | SUBTYPE V-B | | |
| | 863101..863718 | CRISP | SUBTYPE I-C | GTTTCAATCCGCGCCCCCGTGAGGGGGC | 1849 |
| | 863901..864185 | cas2 | | | |
| | 864229..864519 | cas1 | | | |
| | 864519..865271 | cas1 | | | |
| | 865276..865905 | cas4 | | | |
| | 865898..868141 | cas3 | | | |
| | 868146..869006 | cas7c | | | |
| | 868999..871128 | cas8c | | | |
| | 871118..871708 | cas5 | | | |
| | 3312438..3313436 | cas7 | PARTIAL | part CAS-I-E | 1850 |
| | 3313436..3314197 | cas5 | | part CAS-I-E | |
| | 5490463..5494276 | CRISP | SUBTYPE I-E | CGGATCATCCCCGCATCCGCGGGGGACAC | |
| | 5494368..5494697 | cas2 | | | |
| | 5494660..5495604 | cas1 | | | |
| | 5495601..5496332 | cas6e | | | |
| | 5496329..5497150 | cas5 | | | |
| | 5497150..5498190 | cas7 | | | |
| | 5498192..5498809 | cse2gr11 | | | |
| | 5498806..5500468 | cas8e | | | |
| | 5500723..5503275 | cas3 | | | 1851 |
| | 6088472..6089164 | CRISP | | GTTTCAATCCGCGCCCCCGTGAGAGGGCGAC | |

C2c2 FAMILY

| Organism | Coordinates | Gene | Sequence | SEQ ID NO |
|---|---|---|---|---|
| Lachnospiraceae_bacterium_MA20 | 83618..84086 | CRISP | GTCTATTGCCAACTATATCTGGCTTTTCTCAATAC | 1852 |
| | 84323..84483 | cas2 | | |
| | 84630..85007 | - | | |
| | 84983..85198 | - | | |
| | 85203..85790 | - | | |
| | 85822..86001 | - | | |
| | 86024..86353 | - | | |
| | 86350..86529 | - | | |
| | 86801..875296 | - | | |

FIG. 44B

| | | | |
|---|---|---|---|
| | 87964..88992 | Reverse Transcriptase | |
| | 89522..89863 | - | SEQ ID NO: 1853 |
| | 89586..90260 | CRISP | GTCTATTGCCATCTTTATCTGGCTTTTCTCAATAC |
| | 90407..90619 | cas2 | |
| | 90805..94827 | c2c2  SUBTYPE VI | |
| Lachnospiraceae bacterium NK4A179 | | | SEQ ID NO: 1854 |
| | 49..290 | CRISP | GTTATTGCCCTCTATCTTGGGCTCTTCTCATCAAC |
| | 493..1173 | - | |
| | 1273..2298 | - | |
| | 2295..3608 | - | |
| | 3605..5830 | - | SEQ ID NO: 1855 |
| | 5842..10155 | c2c2  SUBTYPE VI | |
| | 10469..10879 | CRISP | GTTATTGCCCTCTTTCTTGGGCTATCTTCTCCAGC |
| [Clostridium]_aminophilum_DSM_ | | | |
| | 1521..2112 | CRISP | GTTTGGAGAACAGCCCGATATAGAGGGCAATAGAC |
| | 2324..2632 | - | SEQ ID NO: 1856 |
| | 2828..3835 | cas1 | |
| | 3843..4127 | cas2 | |
| | 4350..6053 | - | |
| | 6043..7788 | - | |
| | 7789..9981 | - | |
| | 10037..14194 | c2c2  SUBTYPE VI | |
| Lachnospiraceae_bacterium_NK4A | 11419..12360 | cas1 | |
| | 12365..12649 | cas2 | |
| | 12700..13095 | - | SEQ ID NO: 1857 |
| | 12861..13249 | CRISP | GTTTTGAGAATCAGCCCGATATAGAGGGCAATAGAC |
| | 13462..13574 | - | |
| | 13596..17600 | c2c2  SUBTYPE VI | |
| Carnobacterium_gallinarum_DSM_ 4847_strain_MT44 | | | SEQ ID NO: 1858 |
| | 162241..165786 | c2c2  SUBTYPE VI | |
| | 165970..166270 | CRISP | GTTATAGTCCTCTTACATTTAGAGGTAGTCTTTAAT |
| | 166454..167290 | - | SEQ ID NO: 1859 |
| | 167326..167655 | - | |
| | 167735..168299 | CRISP | GTTATAGTCCTCTTACATTTAGAGGTAGTCTTTAAT |
| | 1679832..1680560 | cas6 | |
| | 1680577..1681806 | - | |
| | 1681790..1682131 | - | |
| | 1682128..1683105 | cas7 | |
| | 1683119..1683928 | cas5 | |
| | 1683933..1686251 | cas3 | |
| | 1686351..1686653 | cas1 | SUBTYPE I-B |
| | 1686657..1686935 | cas2 | SEQ ID NO: 1860 |
| | 1687137..1688150 | CRISP | GTTCTTAATCTAAAATAGTGAAATGTAAAT |
| | | | SEQ ID NO: 1861 |
| | 1717964..1718191 | CRISP | GCATTTACATTACATTATTTTAGATTAAGAAC |
| | 2463599..2464031 | CRISP | SEQ ID NO: 1862 |
| | 2514115..2514877 | CRISP | ACTACATTATAGCTGATTCTGTAAGGAAACTATAGC |
| | 2515559..2516140 | UNCHARACTERIZED PROTEIN | |
| | 2516088..2519765 | - | |
| | 2519737..2523318 | - | |
| | 2523330..2525867 | PglZ PROTEIN | SEQ ID NO: 1863 |
| | 2526078..2529383 | cas9 | |
| | 2529569..2530067 | CRISP | ACTACATTATAGCTGATTCTGTAAGGAAACTATAGC |

FIG. 44C-1

Paludibacter_propionicigenes_WB4
_complete_genome

| | | |
|---|---|---|
| 223974..225658 | CRISP | SEQ ID NO: 1864 |
| 224077..224334 | . | TAGTTCCCTTCAATTTTGGGATTATCCA |
| 224479..224874 | . | |
| 225280..225480 | . | |
| 225749..229213 | c2c2   SUBTYPE VI | SEQ ID NO: 1865 |
| 3132640..3133201 | CRISP | CCTTTCAAACGAAGGGCACTTACAAC |

Listeria_seeligeri_serovar_1/2b_str.
_SLCC3954_complete_genome

| | | |
|---|---|---|
| 443925..445633 | CRISP | SEQ ID NO: 1866<br>GTTTTAACTACTTATTGTGAAATGTAAAT |

FIG. 44C-2

| | | |
|---|---|---|
| 445977..446714 | cas6 | |
| 446730..448418 | cas8b2 | |
| 448408..449277 | cas7 | |
| 449234..450043 | cas5 | |
| 450113..452323 | cas3 | |
| 452413..452823 | cas4 | |
| 452827..453825 | cas1 | SUBTYPE I-B |
| 453800..454108 | cas2 | SEQ ID NO: 1867 |
| 454307..456019 | CRISP | GTTTTAATTACTTATTGTGAAATGTAAAT |
| 1174123..1174423 | CRISP | GTAAGAGACTACCTCTATATGAAAGAGGACTAAAAC   SEQ ID NO: 1868 |
| 1174428..1177790 | c2c2   SUBTYPE VI | |

Listeria_weihenstephanensis_FSL_
R9-0317_c4

| | | |
|---|---|---|
| 42458..42626 | CRISP | SEQ ID NO: 1869 |
| 42871..43125 | . | GATTTAGAGTACCTCAAAACAGAAGAGGACTAAAAC |
| 43134..46046 | c2c2   SUBTYPE VI | SEQ ID NO: 1870 |
| 46240..46672 | CRISP | GATTTAGAGTAGCTCAAAAAAGAAGAGGTCTAAAAC |

Listeria_newyorkensis_strain_FSL_
M6-0635_contig000012

| | | |
|---|---|---|
| 169658..169891 | CRISP | SEQ ID NO: 1871 |
| 170136..173309 | c2c2   SUBTYPE VI | GATTTAGAGTACCTCAAAACAAAAGAGGACTAAAAC |

FIG. 44D-1

Leptotrichia_wadei_F0279_Scaffold
222711..223040  cas2
223024..223941  cas1
223961..227554  c2c2         SUBTYPE VI
227692..228117  -
228220..228402  HicA

SEQ ID NO: 1872

Leptotrichia_wadei_F0279_Scaffold   545623324
63767..63940    CRISP           GTTTTAGTCCCCTTCGTTTTTGGGGTAGT
64576..64899    cas2
64899..65800    cas1
65814..69272    c2c2            SUBTYPE VI
69302..69718    -
70012..70194    HicA toxin

SEQ ID NO: 1873

Leptotrichia_buccalis_DSM_1135
502904..503090  CRISP           TCAATCCTTATTTTAATGGATTCACTATTCTTAC 870500..870778  cas2
870780..871820  cas1
871808..872296  cas4            SUBTYPE I-B
872315..874729  cas3
874749..875513  cas5
875516..876412  cas7
876415..878184  cas8b2                          SEQ ID NO: 1874
878209..878991  cas6
879301..884707  CRISP           GTTTTAATAGCACAAATTGTATTGTAAAT 1157516..1159441  cas10         SUBTYPE III-D
1159329..1161302  csm3gr7
1161326..1161835  -
1161860..1162675  csm3gr7
1162686..1163591  csm3gr7
1163591..1164016  -
1164003..1165766  csm3gr7
1165800..1166450  cas6

1171263..1171907  cas4
1171923..1172210  cas2          SUBTYPE NON DEFINED (ADAPTATION MODULE ONLY)
1172273..1173244  cas1
1173383..1173997  -
1174084..1175688  RNAse III
1175859..1176143  Ferredoxin
1176334..1178430  -
1178454..1180619  csx1
1180675..1181067  csx20

SEQ ID NO: 1875

1403072..1403635  CRISP         GTTTCAATCCTTGTTTTAATGGATAACTTACTTTAAC

FIG. 44D-2

SEQ ID NO: 1876

1616840..1617773  CRISP         GTTTCAATCCTTGTTTTAATGGATACTCTACTTTAAC

1860459..1883938  c2c2          SUBTYPE VI
1883968..1884390  HicB ANTITOXIN
1884688..1884870  HicA TOXIN

Leptotrichia_wadei_F0279_L_wade
iHMPREF9015     544240836
24883..25200    cas2
25190..26113    cas1
26119..29661    c2c2            SUBTYPE VI

FIG. 44E-1

| | | | | |
|---|---|---|---|---|
| Leptotrichia_wadei_F0279_Scaffold | 545622515 | | | |
| | 24883..25200 | cas2 | | |
| | 25190..26113 | cas1 | | |
| | 26119..29661 | c2c2 | SUBTYPE VI | |
| Leptotrichia_sp._oral_taxon_879_str._F0557_Scaffold38 | 545620503 | | | |
| | 15429..15746 | cas2 | | |
| | 15736..16659 | cas1 | | |
| | 16680..20837 | c2c2 | SUBTYPE VI | |
| Leptotrichia_shahii_DSM_19757_B031DRAFT_scaffold_9.10 | 483857172 | | | SEQ ID NO: 1877 |
| | 34195..34366 | CRISP | | GTTTTAGTCCCCTTCGATATTGGGGTGGTCTATATC |
| | 34371..34508 | - | | |
| | 34505..34822 | cas2 | | |
| | 34812..35663 | cas1 | | |
| | 35756..39925 | c2c2 | SUBTYPE VI | |
| Rhodobacter_capsulatus_SB_1003 | 294675557 | | | SEQ ID NO: 1878 |
| | 1349552..1349731 | CRISP | | ACCTCTCCCGCCAGTAAGCGGATTGAGAC |
| | 1349932..1351398 | cas10 | | |
| | 1351395..1353041 | csm3gr7 | | |
| | 1353038..1355665 | csm3gr7 | | |
| | 1355662..1355952 | cas2 | | SEQ ID NO: 1879 |
| | 1356300..1356477 | CRISP | | GCCCAGACACCTCTCCCGCCAGTAAGCGGATTGAGAC |
| | 1356526..1358127 | RT | SUBTYPE III-D, PARTIAL | SEQ ID NO: 1880 |
| | 1358648..1358901 | CRISP | | GCCCAGACACCTCTCCCGCCAGTAAGCGGATTGAGAC |
| | 1358965..1359873 | cas6 | | |
| | 1386763..1387389 | WYL | | |
| | 1387448..1389712 | cas3HD | | |
| | 1389834..1390532 | cas5 | | |
| | 1390529..1392268 | cas8c | | |
| | 1392265..1393215 | cas7 | | |
| | 1393215..1393865 | cas4 | | |
| | 1393862..1394896 | cas1 | SUBTYPE I-C | SEQ ID NO: 1881 |
| | 1394898..1395188 | cas2 | | |
| | 1395365..1398003 | CRISP | | GTCGCTCCCCCCGCGGGGGCGTGGATCGAAAC |
| | | | | SEQ ID NO: 1882 |
| | 1434350..1434910 | CRISP | | GTCGCTCCCCCCGCGGGGGCGTGGATCGAAAC |
| | 1447764..1448072 | cas5 | | |
| | | | | SEQ ID NO: 1883 |
| | 2157353..2157628 | RT | | GGTTCAGTCCGCCGTCGTCTTGGCGGTGATGTGA |
| | 2157796..2158040 | CRISP | | |
| | 2158410..2162267 | c2c2 | SUBTYPE VI | SEQ ID NO: 1884 |
| | 2557574..2557752 | CRISP | | GCCCTCTCCTCCTCCCTGGGCCG |
| Rhodobacter_capsulatus_R121_seq | 564874736 | | | SEQ ID NO: 1885 |
| | 320757..321032 | RT | | GGTTCAGTCCGCCGTCGTCTTGGCGGTGATGTGA |
| | 321200..321444 | CRISP | | |
| | 321814..325671 | c2c2 | SUBTYPE VI | |
| Rhodobacter_capsulatus_DE442_seq0020 | 565827203 | | | SEQ ID NO: 1886 |
| | 463749..464024 | RT | | |
| | 464192..464436 | CRISP | | |
| | 464806..468663 | c2c2 | SUBTYPE VI | GGTTCAGTCCGCCGTCGTCTTGGCGGTGATGTGA |

SEQ ID NOs: 1887 and 1888

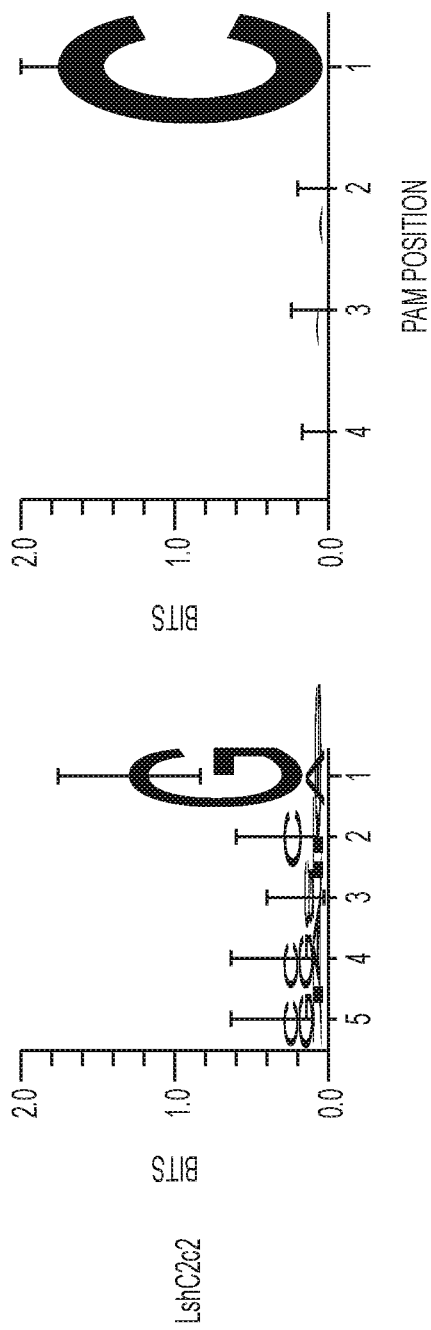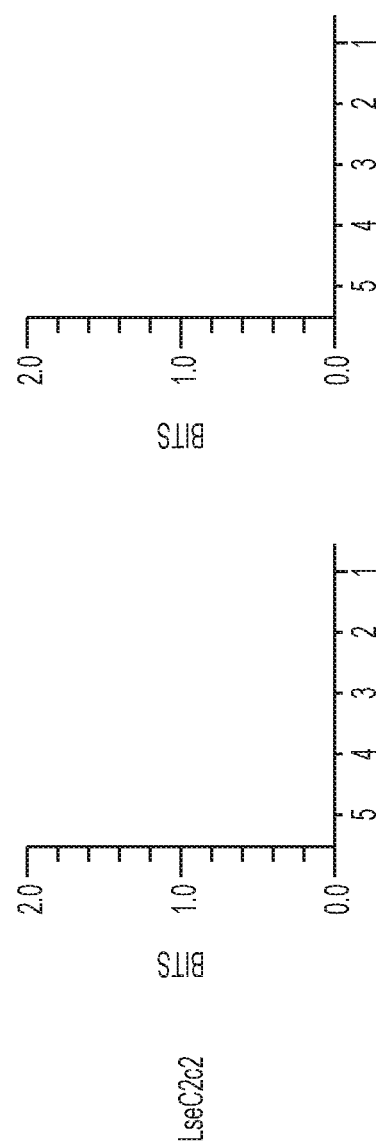
FIG. 55

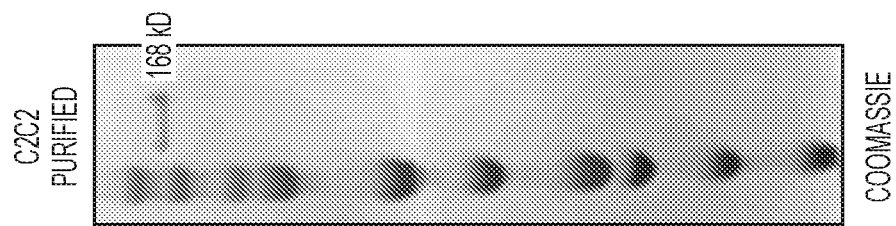
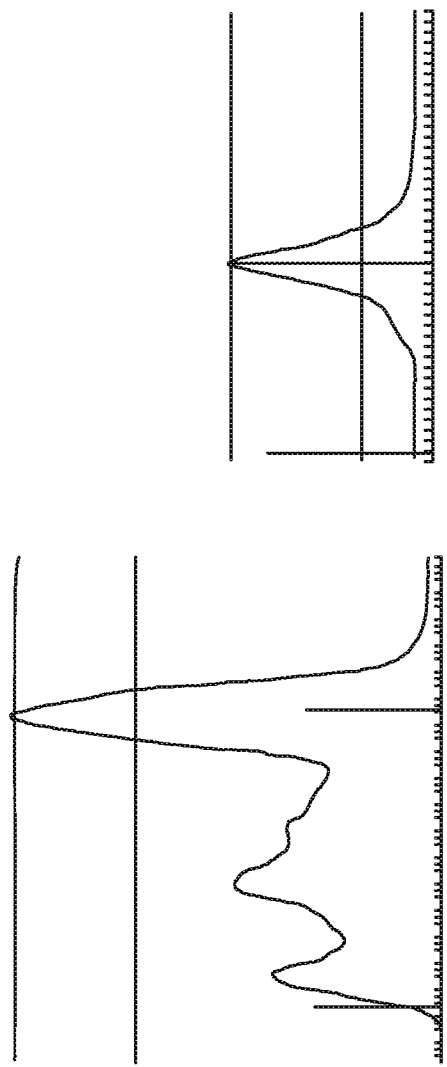
FIG. 57

SEQ ID NO: 1899

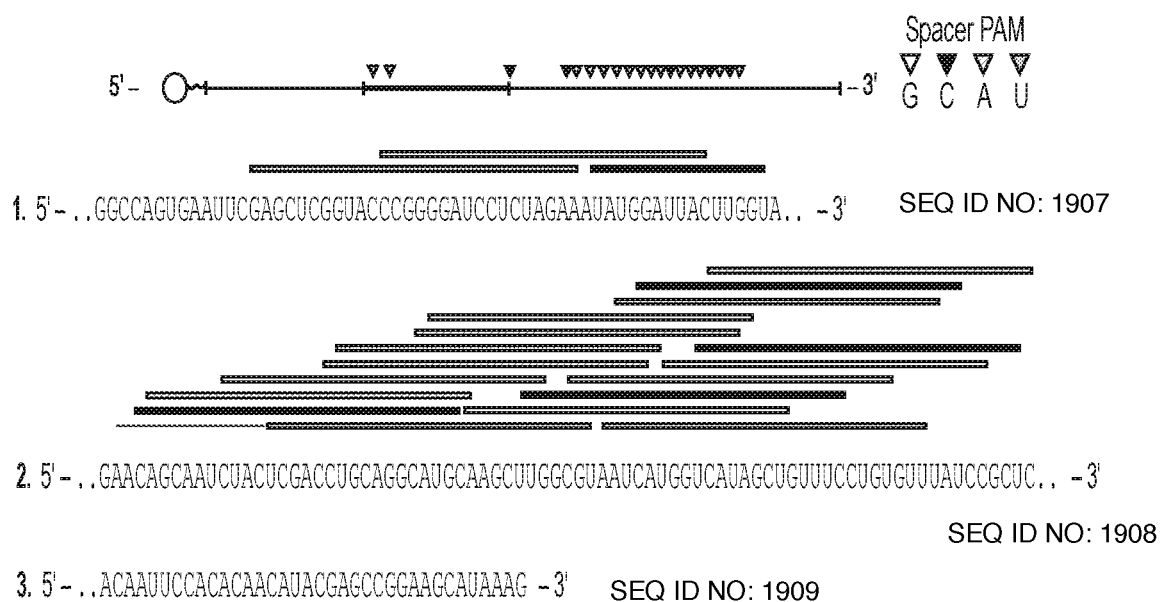
1. 5'-...GGCCAGUGAAUUCGAGCUCGGUACCCGGGGAUCCUCUAGAAAUAUGGAUUACUUGGUA..-3'  SEQ ID NO: 1907
2. 5'-...GAACAGCAAUCUACUCGACCUGCAGGCAUGCAAGCUUGGCGUAAUCAUGGUCAUAGCUGUUUCCUGUGUUUAUCCGCUC..-3'
SEQ ID NO: 1908
3. 5'-...ACAAUUCCACACAACAUACGAGCCGGAAGCAUAAAG -3'  SEQ ID NO: 1909
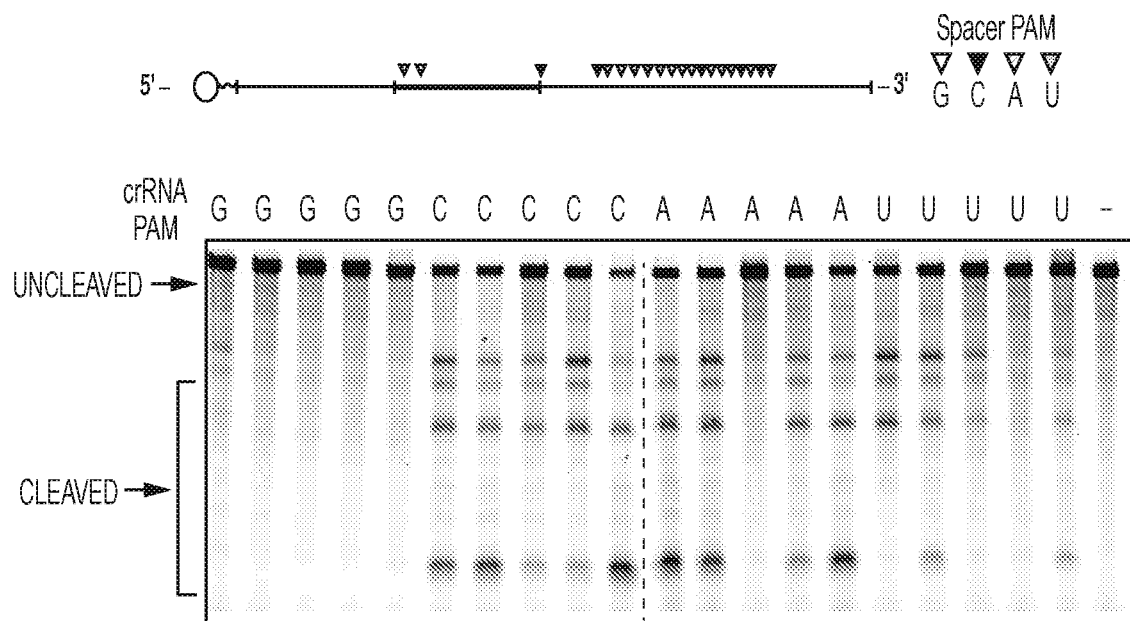
FIG. 75I

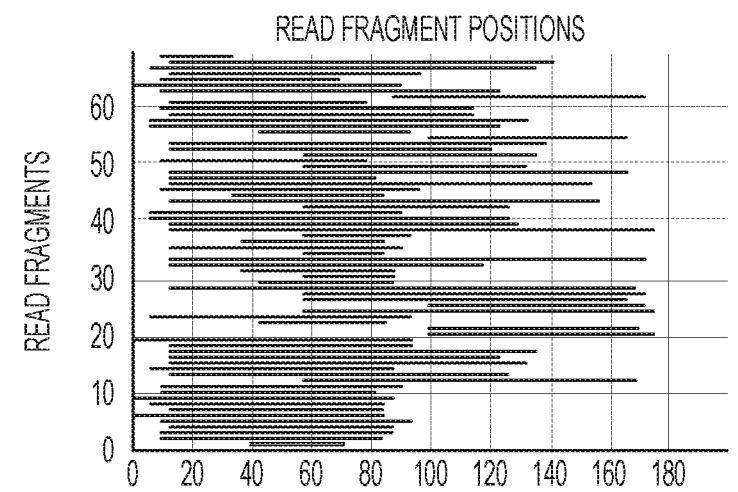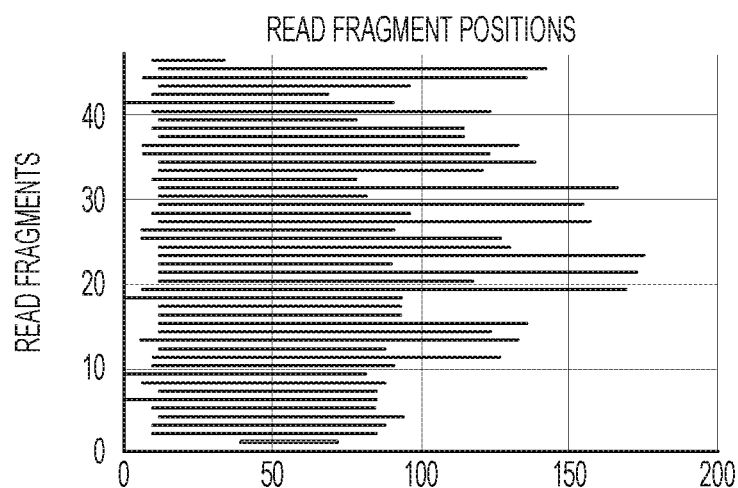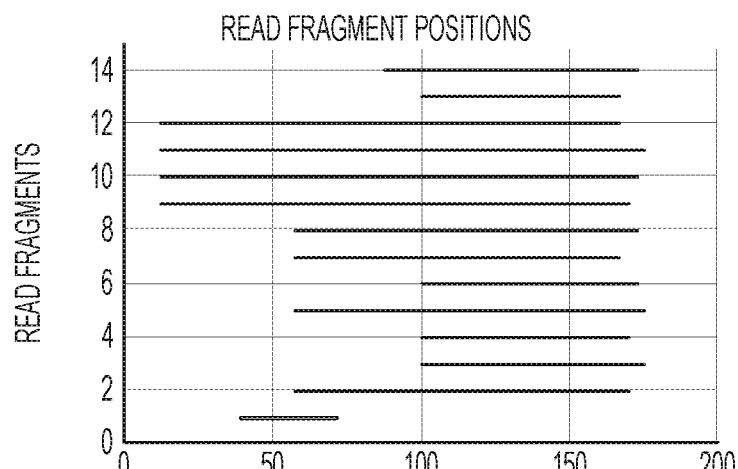
FIG. 82

SEQ ID NO: 1915

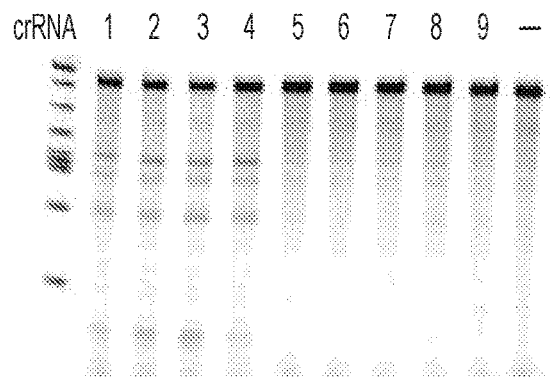

FIG. 92C

| | | | |
|---|---|---|---|
| 1 | AUAAGCCCACC —5'<br>U ||||<br>CGAACGGGACUAAAAC —3' | SEQ ID NO: 1928 | |
| 2 | AUAACGCCCACC —5'<br>U ||||<br>CGAAGCGGGACUAAAAC —3' | SEQ ID NO: 2231 | |
| 3 | AUAACCGCACC —5'<br>U ||||<br>CGAAGGCGACUAAAAC —3' | SEQ ID NO: 1930 | |
| 4 | AUAACCCGACC —5'<br>U ||||<br>CGAAGGGCACUAAAAC —3' | SEQ ID NO: 1931 | |
| 5 | AUAAGGGGACC —5'<br>U ||||<br>CGAACCCCACUAAAAC —3' | SEQ ID NO: 1932 | |
| 6 | A<br>AUAACC CCACC —5'<br>U || ||<br>CGAAGG GGACUAAAAC —3' | SEQ ID NO: 1933 | |
| 7 | AUAACCCAACC 5'<br>U |||<br>CGAAGGGGACUAAAAC —3' | SEQ ID NO: 1934 | |
| 8 | AUAACCCACC —5'<br>A |||<br>U CGAAGGGGACUAAAAC —3' | SEQ ID NO: 2232 | |
| 9 | AUAACCCCCACC —5'<br>U |||||<br>CGAAGGGGACUAAAAC —3' | SEQ ID NO: 1936 | |
| WT | AUAACCCCACC —5'<br>U ||||<br>CGAAGGGGACUAAAAC —3' | SEQ ID NO: 1937 | |

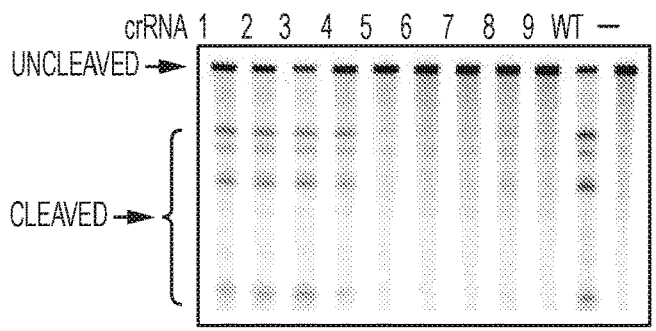

FIG. 92D

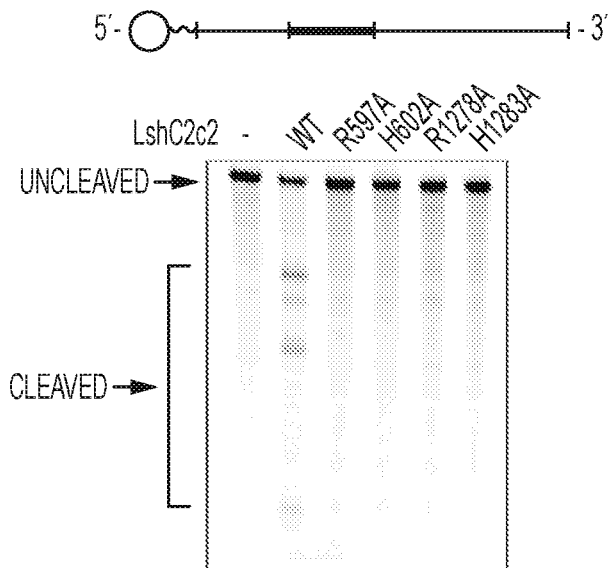
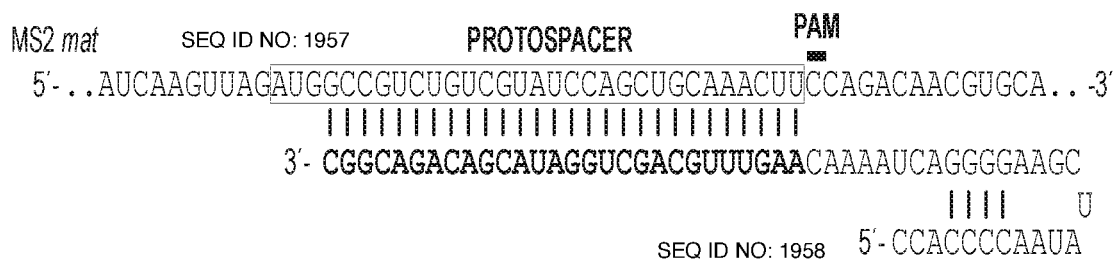
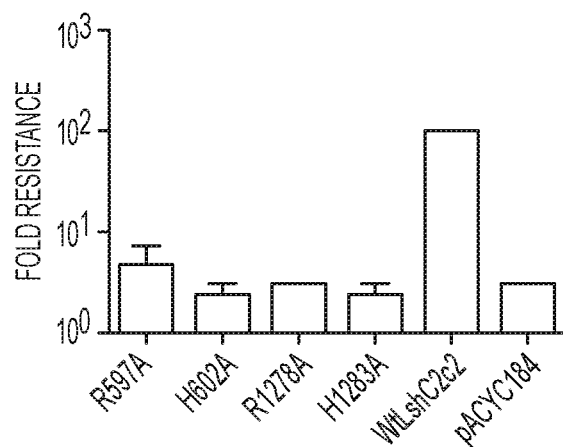
FIG. 97C

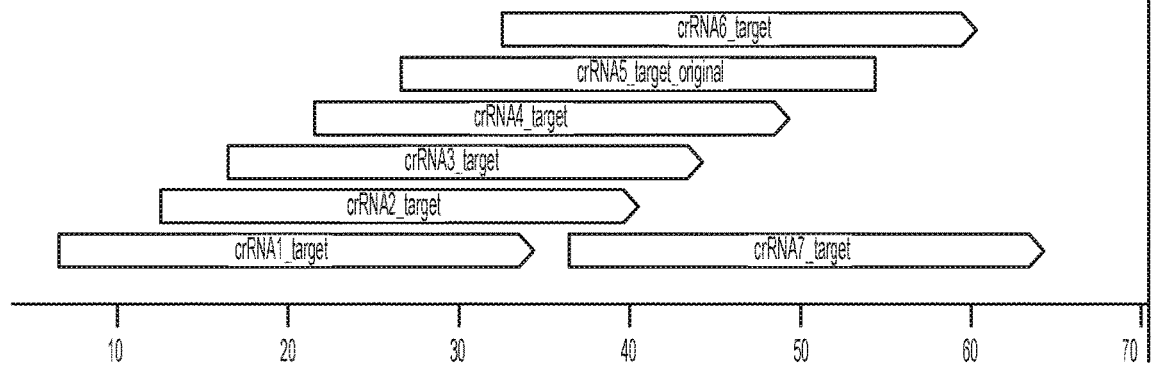
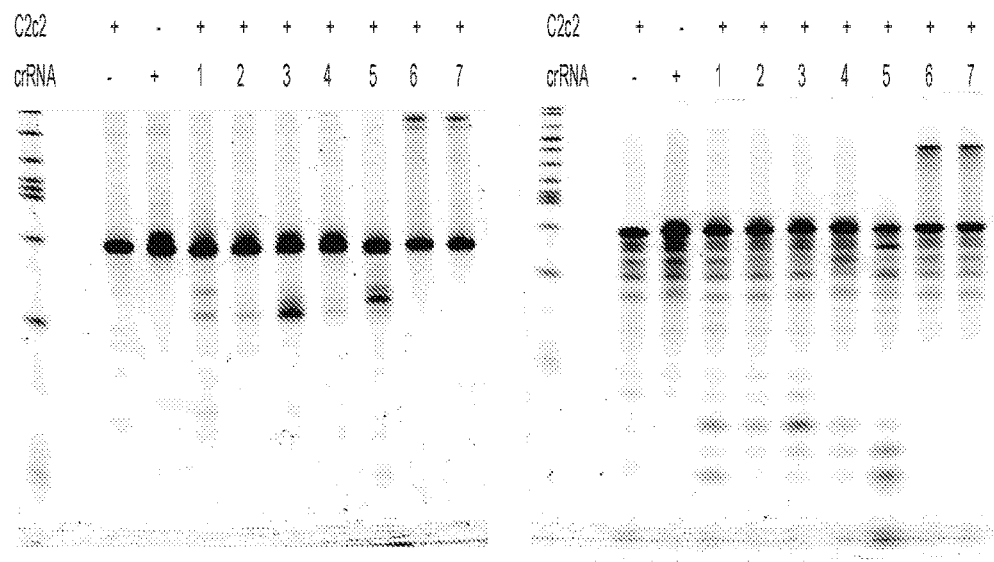
FIG. 103

SEQ ID NO: 1961

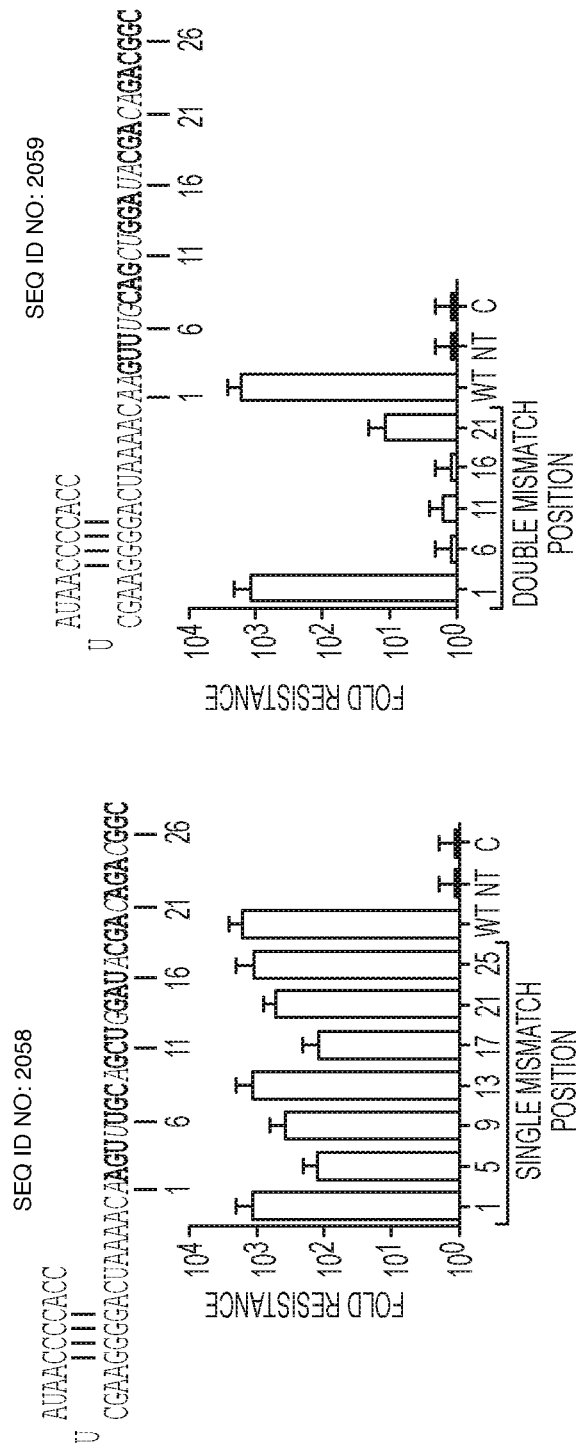

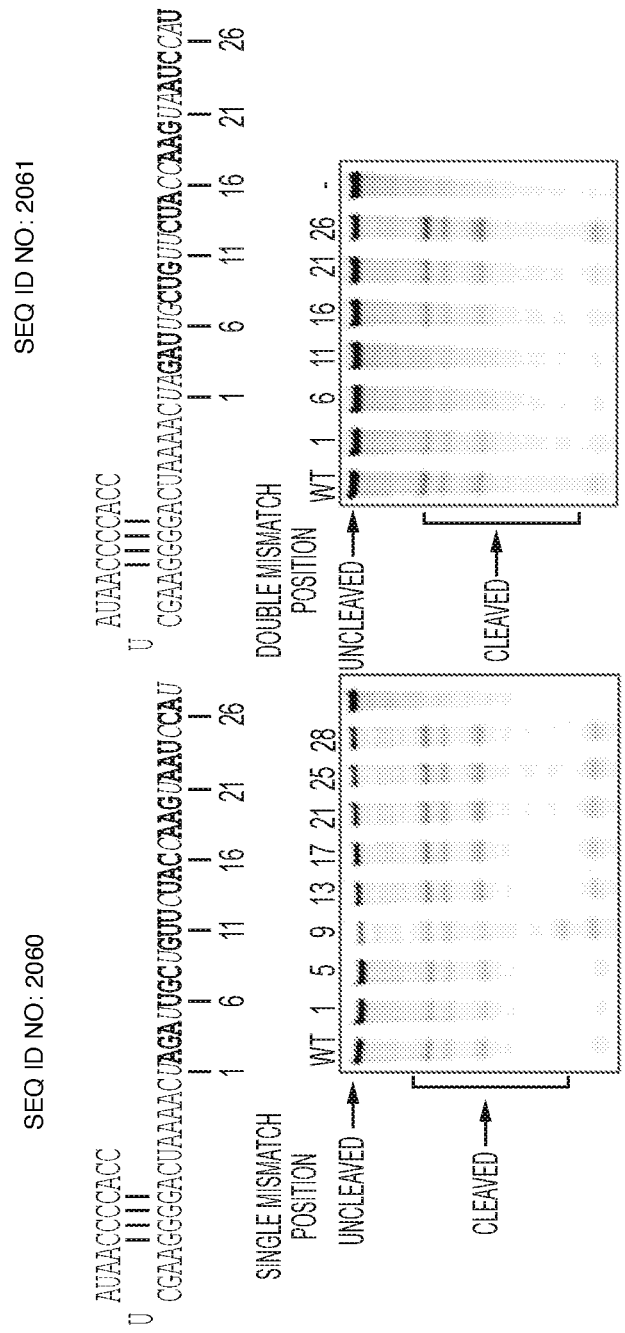

FREE ENERGY OF SECONDARY STRUCTURE: -122.76 kcal/mol

FREE ENERGY OF SECONDARY STRUCTURE: -199.16 kcal/mol

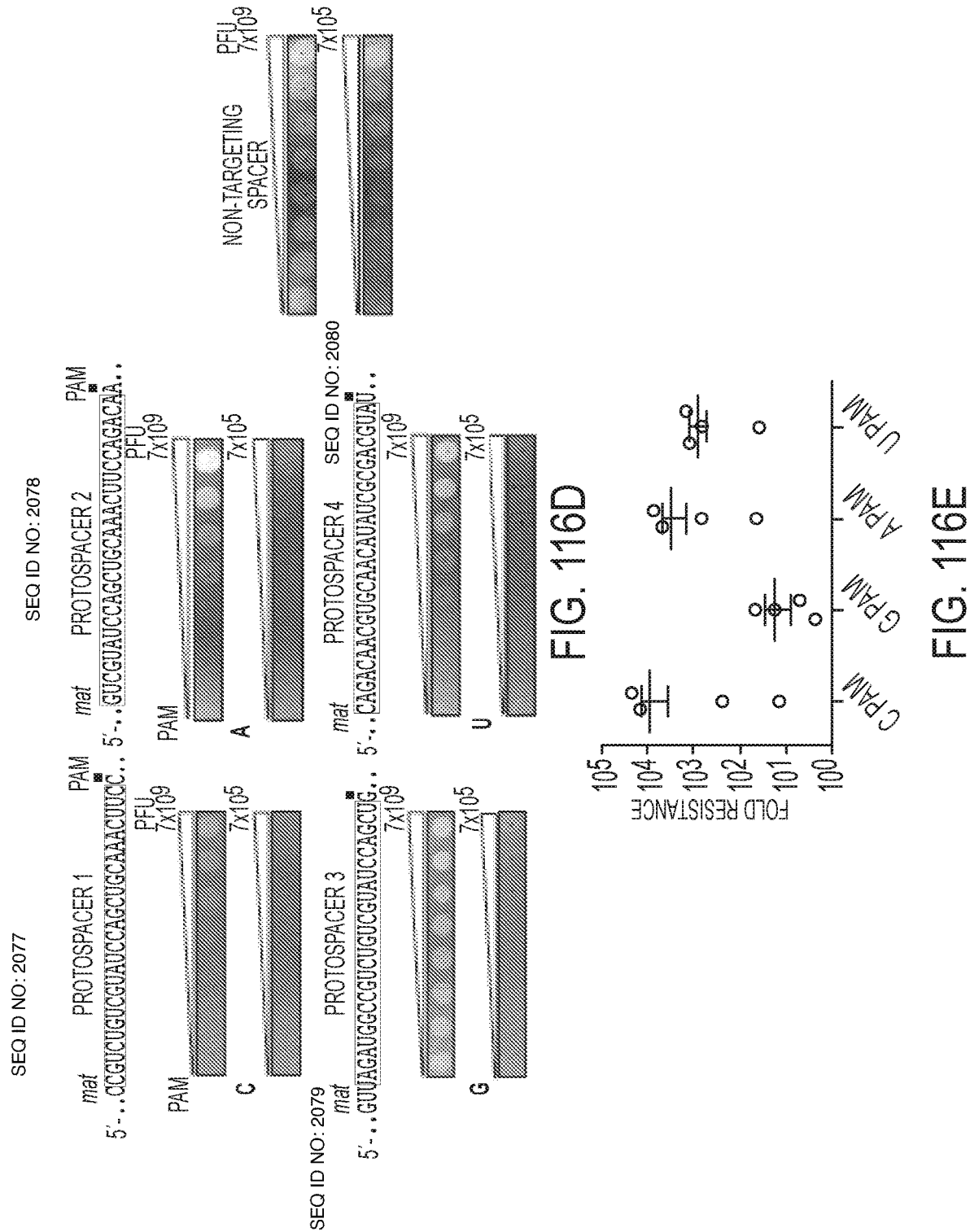

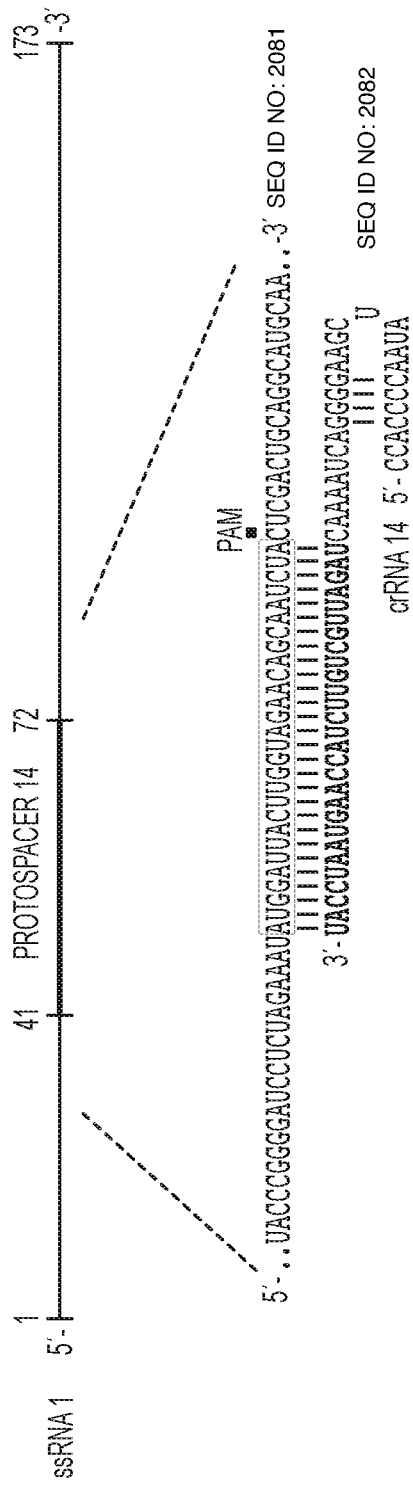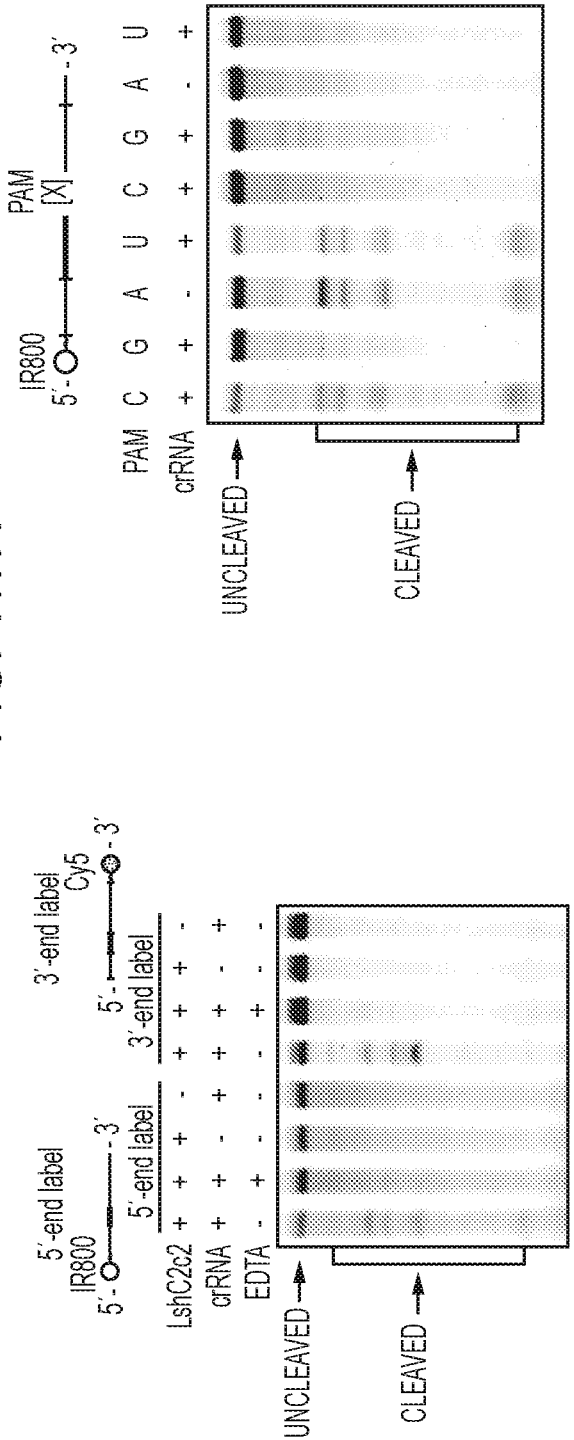
FIG. 117A
FIG. 117B
FIG. 117C

FIG. 118A
FIG. 118B
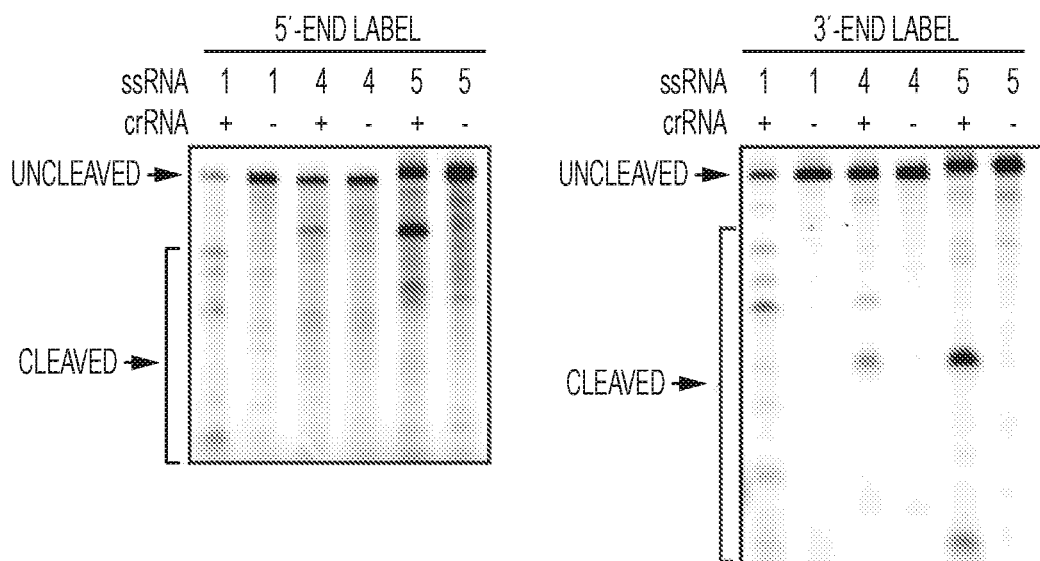
FIG. 118C

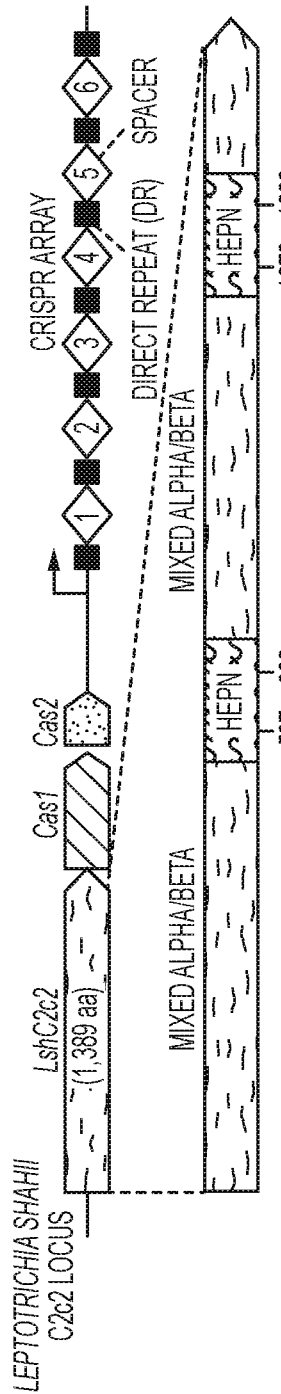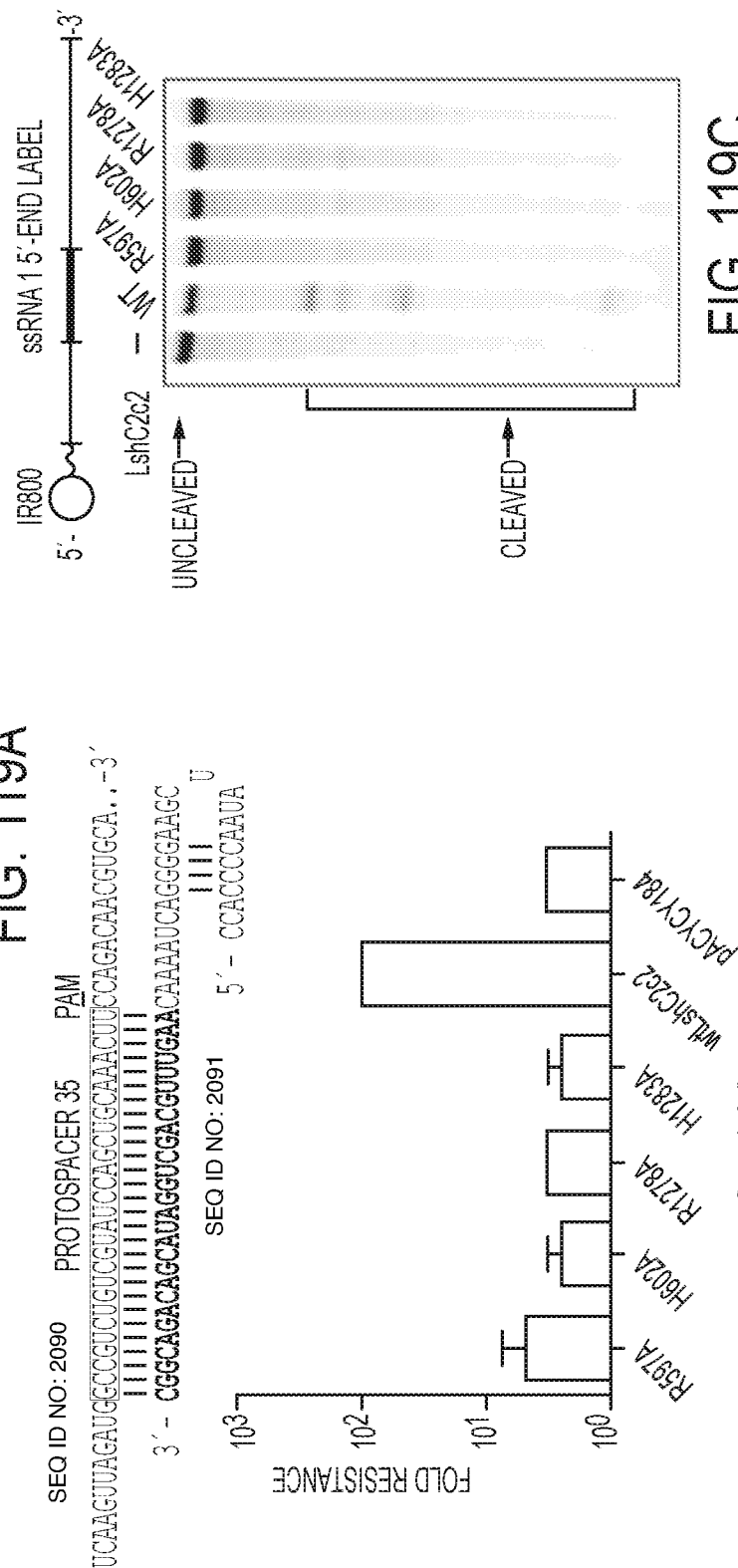
FIG. 119A
FIG. 119B
FIG. 119C

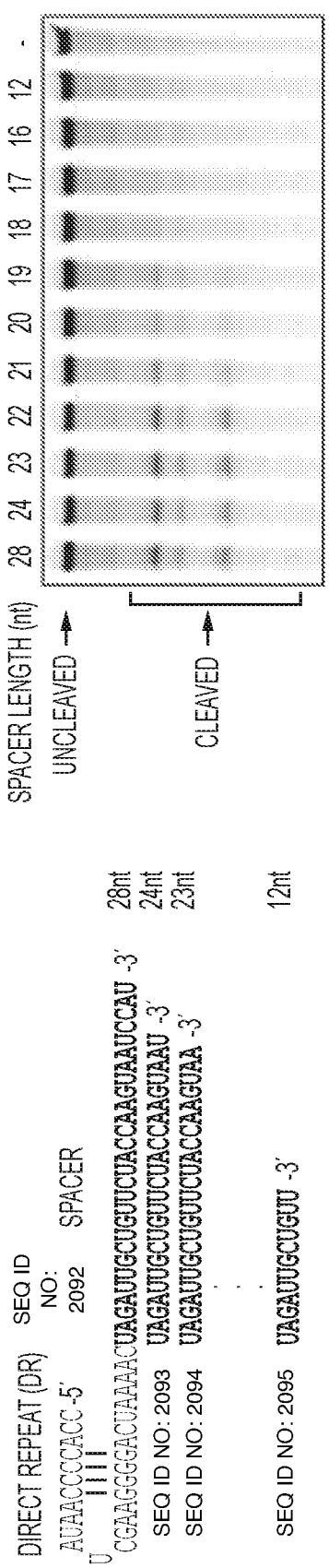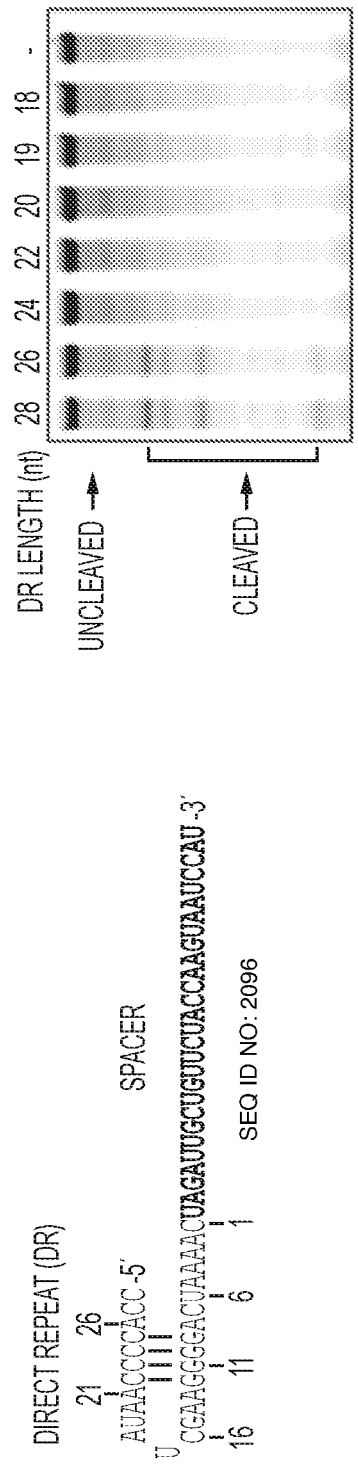

*LEPTOTRICHIA SHAHII DSM 19757* LOCUS EXPRESSED IN *E. COLI*

SEQ ID NO: 2149

```
   AUAACCCCACC - 5'
 U      ||||
   CGAAGGGGACUAAAAC - 3'
```

LshC2c2 crRNA
DIRECT REPEAT (DR)

READS ≤ 55nt
111,115

ALL READS
113,229

LshC2c2   cas1   cas2 crRNA

5'-CCACCCCAAUAUCGAAGGGGACUAAAACNNNNNNNNNNNNNNNNNNNNNNNNNNNN-3'

SEQ ID NO: 2150

14-28nt SPACER

FIG. 126

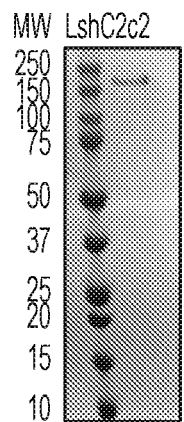
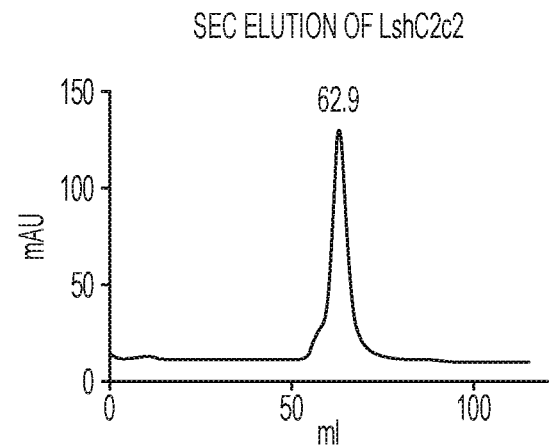
FIG. 131A  FIG. 131B
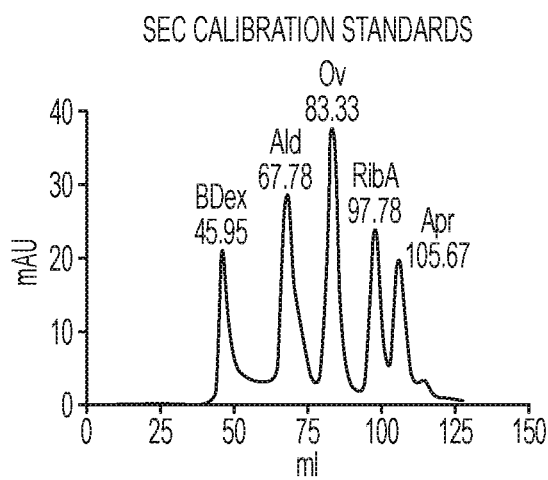
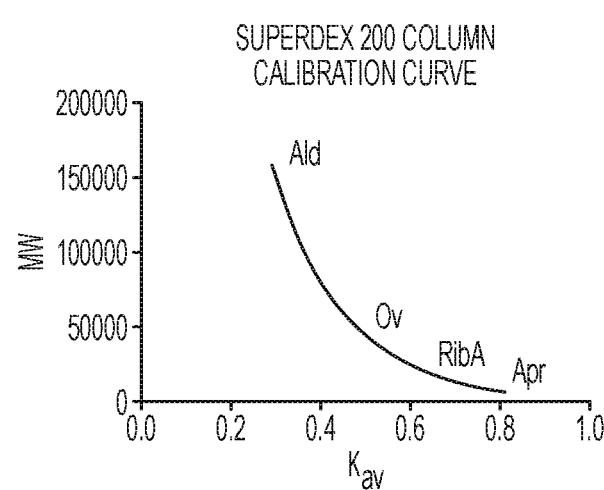
FIG. 131C  FIG. 131D

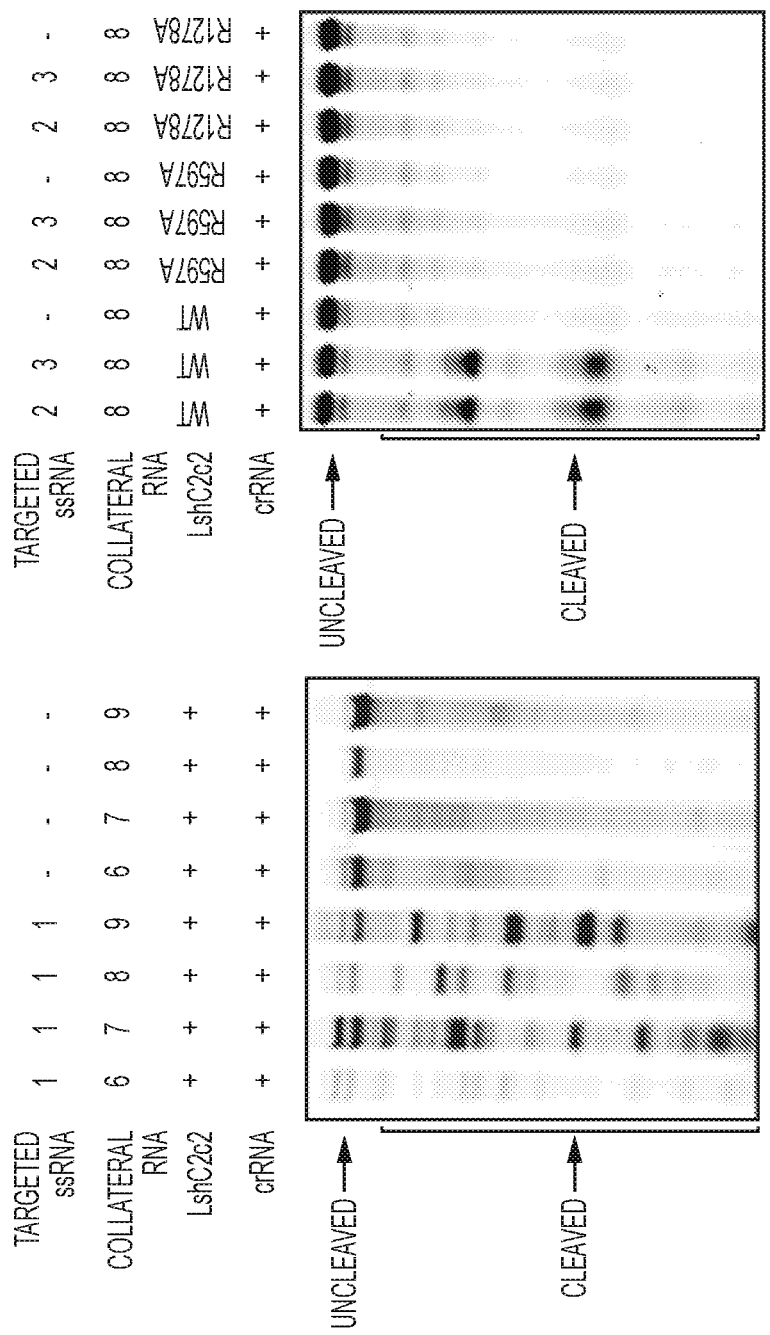

CRISPR ENZYMES AND SYSTEMS

RELATED APPLICATIONS AND INCORPORATION BY REFERENCE

This application is is a continuation-in-part of International Application PCT/US2016/038258 filed Jun. 17, 2016 and published as Publication No. WO2016/205764 on Dec. 22, 2016, and claims the benefit of U.S. Provisional Patent Application Nos. 62/320,231, filed Apr. 8, 2016, 62/181, 675, filed Jun. 18, 2015, 62/285,349, filed Oct. 22, 2015, 62/296,522, filed Feb. 17, 2016.

STATEMENT AS TO FEDERALLY SPONSORED RESEARCH

This invention was made with government support under grant numbers MH100706, MH110049, DK97768 and GM010407 awarded by the National Institutes of Health. The government has certain rights in the invention.

All documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

SEQUENCE LISTING

The contents of the Substitute electronic sequence listing (BROD_3480US_ST25.txt"; Size is 1.1 MB) was created on Apr. 17, 2020 is herein incorporated by reference in its entirety and replaces any and all previously submitted Sequence Listings.

FIELD OF THE INVENTION

The present invention generally relates to systems, methods and compositions used for the control of gene expression involving sequence targeting, such as perturbation of gene transcripts or nucleic acid editing, that may use vector systems related to Clustered Regularly Interspaced Short Palindromic Repeats (CRISPR) and components thereof.

BACKGROUND OF THE INVENTION

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome and transcriptome engineering technologies that employ novel strategies and molecular mechanisms and are affordable, easy to set up, scalable, and amenable to targeting multiple positions within the eukaryotic genome and transcriptome. This would provide a major resource for new applications in genome engineering and biotechnology.

The CRISPR-Cas systems of bacterial and archaeal adaptive immunity show extreme diversity of protein composition and genomic loci architecture. The CRISPR-Cas system loci has more than 50 gene families and there is no strictly universal genes indicating fast evolution and extreme diversity of loci architecture. So far, adopting a multi-pronged approach, there is comprehensive cas gene identification of about 395 profiles for 93 Cas proteins. Classification includes signature gene profiles plus signatures of locus architecture. A new classification of CRISPR-Cas systems is proposed in which these systems are broadly divided into two classes, Class 1 with multisubunit effector complexes and Class 2 with single-subunit effector modules exemplified by the Cas9 protein (FIGS. 1A and 1B). Novel effector proteins associated with Class 2 CRISPR-Cas systems may be developed as powerful genome engineering tools and the prediction of putative novel effector proteins and their engineering and optimization is important.

Citation or identification of any document in this application is not an admission that such document is available as prior art to the present invention.

SUMMARY OF THE INVENTION

The CRISPR-Cas adaptive immune system defends microbes against foreign genetic elements via DNA or RNA-DNA interference. Here, we interrogate the Class 2 type VI single-component CRISPR-Cas effector C2c2 and characterize it as an RNA-guided RNase. We demonstrate that C2c2 (e.g. from *Leptotrichia shahii*) provides robust interference against RNA phage infection. Through in vitro biochemical analysis and in vivo assays, we show that C2c2 can be programmed to cleave ssRNA targets carrying protospacers flanked by a 3' H (non-G) PAM. Cleavage is mediated by catalytic residues in the two conserved HEPN domains of C2c2, mutations in which generate a catalytically inactive RNA-binding protein. C2c2 is guided by a single crRNA and can be re-programmed to deplete specific mRNAs in vivo. We show that LshC2c2 can be targeted to a specific site of interest and can carry out non-specific RNase activity once primed with the cognate target RNA. These results broaden our understanding of CRISPR-Cas systems and demonstrate the possibility of harnessing C2c2 to develop a broad set of RNA-targeting tools.

There exists a pressing need for alternative and robust systems and techniques for targeting nucleic acids or polynucleotides (e.g. DNA or RNA or any hybrid or derivative thereof) with a wide array of applications. This invention addresses this need and provides related advantages. Adding the novel DNA or RNA-targeting systems of the present application to the repertoire of genomic and epigenomic targeting technologies may transform the study and perturbation or editing of specific target sites through direct detection, analysis and manipulation. To utilize the DNA or RNA-targeting systems of the present application effectively for genomic or epigenomic targeting without deleterious effects, it is critical to understand aspects of engineering and optimization of these DNA or RNA targeting tools.

The Class 2 type VI effector protein C2c2 is a RNA-guided RNase that can be efficiently programmed to degrade ssRNA. C2c2 achieves RNA cleavage through conserved basic residues within its two HEPN domains, in contrast to the catalytic mechanisms of other known RNases found in CRISPR-Cas systems. Mutation of the HEPN domain, such as (e.g. alanine) substitution, of any of the four predicted HEPN domain catalytic residues converted C2c2 into an inactive programmable RNA-binding protein (dC2c2, analogous to dCas9).

The ability of dC2c2 to bind to specified sequences could be used in several aspects according to the invention to (i) bring effector modules to specific transcripts to modulate the function or translation, which could be used for large-scale screening, construction of synthetic regulatory circuits and other purposes; (ii) fluorescently tag specific RNAs to visualize their trafficking and/or localization; (iii) alter RNA localization through domains with affinity for specific subcellular compartments; and (iv) capture specific transcripts (through direct pull down of dC2c2 or use of dC2c2 to localize biotin ligase activity to specific transcripts) to enrich for proximal molecular partners, including RNAs and proteins.

Active C2c2 should also have many applications. An aspect of the invention involves targeting a specific transcript for destruction, as with RFP here. In addition, C2c2, once primed by the cognate target, can cleave other (non-complementary) RNA molecules in vitro and can inhibit cell growth in vivo. Biologically, this promiscuous RNase activity may reflect a programmed cell death/dormancy (PCD/D)-based protection mechanism of the type VI CRISPR-Cas systems. Accordingly, in an aspect of the invention, it might be used to trigger PCD or dormancy in specific cells—for example, cancer cells expressing a particular transcript, neurons of a given class, cells infected by a specific pathogen, or other aberrant cells or cells the presence of which is otherwise undesirable.

The invention provides a method of modifying nucleic acid sequences associated with or at a target locus of interest, the method comprising delivering to said locus a non-naturally occurring or engineered composition comprising a Type VI CRISPR-Cas loci effector protein and one or more nucleic acid components, wherein the effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment, the sequences associated with or at the target locus of interest comprises RNA or DNA and the effector protein is encoded by a type VI CRISPR-Cas loci.

It will be appreciated that the terms Cas enzyme, CRISPR enzyme, CRISPR protein, Cas protein and CRISPR Cas are generally used interchangeably and at all points of reference herein refer by analogy to novel CRISPR effector proteins further described in this application, unless otherwise apparent, such as by specific reference to Cas9. The CRISPR effector proteins described herein are preferably C2c2 effector proteins.

The invention provides a method of modifying sequences associated with or at a target locus of interest, the method comprising delivering to said sequences associated with or at the locus a non-naturally occurring or engineered composition comprising a C2c2 loci effector protein and one or more nucleic acid components, wherein the C2c2 effector protein forms a complex with the one or more nucleic acid components and upon binding of the said complex to the locus of interest the effector protein induces the modification of sequences associated with or at the target locus of interest. In a preferred embodiment, the modification is the introduction of a strand break. In a preferred embodiment the C2c2 effector protein forms a complex with one nucleic acid component; advantageously an engineered or non-naturally occurring nucleic acid component. The induction of modification of sequences associated with or at the target locus of interest can be C2c2 effector protein-nucleic acid guided. In a preferred embodiment the one nucleic acid component is a CRISPR RNA (crRNA). In a preferred embodiment the one nucleic acid component is a mature crRNA or guide RNA, wherein the mature crRNA or guide RNA comprises a spacer sequence (or guide sequence) and a direct repeat sequence or derivatives thereof. In a preferred embodiment the spacer sequence or the derivative thereof comprises a seed sequence, wherein the seed sequence is critical for recognition and/or hybridization to the sequence at the target locus. In a preferred embodiment, the sequences associated with or at the target locus of interest comprise linear or super coiled DNA.

Aspects of the invention relate to C2c2 effector protein complexes having one or more non-naturally occurring or engineered or modified or optimized nucleic acid components. In a preferred embodiment the nucleic acid component of the complex may comprise a guide sequence linked to a direct repeat sequence, wherein the direct repeat sequence comprises one or more stem loops or optimized secondary structures. In certain embodiments, the direct repeat has a minimum length of 16 nts, such as at least 28 nt, and a single stem loop. In further embodiments the direct repeat has a length longer than 16 nts, preferably more than 17 nts, such as at least 28 nt, and has more than one stem loop or optimized secondary structures. In particular embodiments, the direct repeat has 25 or more nts, such as 26 nt, 27 nt, 28 nt or more, and one or more stem loop structures. In a preferred embodiment the direct repeat may be modified to comprise one or more protein-binding RNA aptamers. In a preferred embodiment, one or more aptamers may be included such as part of optimized secondary structure. Such aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

The invention provides methods of genome editing and transcriptome perturbation wherein the method comprises two or more rounds of C2c2 effector protein targeting and cleavage. In certain embodiments, a first round comprises the C2c2 effector protein cleaving sequences associated with a target locus far away from the seed sequence and a second round comprises the C2c2 effector protein cleaving sequences at the target locus. In certain such embodiments of the invention, a first round of targeting by a C2c2 effector protein results in a strand break and a second round of targeting by the C2c2 effector protein results in a second strand break. In an embodiment of the invention, one or more rounds of targeting by a C2c2 effector protein results in staggered cleavage that may be repaired.

The invention also provides a method of modifying a target locus of interest, the method comprising delivering to said locus a non-naturally occurring or engineered composition comprising a C2c2 loci effector protein and one or more nucleic acid components, wherein the C2c2 effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised within an RNA molecule. Also, the target locus of interest may be comprised within a DNA molecule, and in certain embodiments, within a transcribed DNA molecule. In such methods the target locus of interest may be comprised in a nucleic acid molecule in vitro.

In such methods the target locus of interest may be comprised in a nucleic acid molecule within a cell. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced.

The mammalian cell many be a non-human mammal, e.g., primate, bovine, ovine, porcine, canine, rodent, Leporidae such as monkey, cow, sheep, pig, dog, rabbit, rat or mouse cell. The cell may be a non-mammalian eukaryotic cell such as poultry bird (e.g., chicken), vertebrate fish (e.g., salmon) or shellfish (e.g., oyster, claim, lobster, shrimp) cell. The cell may also be a plant cell. The plant cell may be of a monocot or dicot or of a crop or grain plant such as cassava, corn, sorghum, soybean, wheat, oat or rice. The plant cell may also be of an algae, tree or production plant, fruit or vegetable (e.g., trees such as citrus trees, e.g., orange, grapefruit or lemon trees; peach or nectarine trees; apple or pear trees; nut trees such as almond or walnut or pistachio trees; nightshade plants; plants of the genus *Brassica*; plants of the genus *Lactuca*; plants of the genus *Spinacia*; plants of the genus *Capsicum*; cotton, tobacco, asparagus, carrot, cabbage, broccoli, cauliflower, tomato, eggplant, pepper, lettuce, spinach, strawberry, blueberry, raspberry, blackberry, grape, coffee, cocoa, etc).

The invention provides a method of modifying a target locus of interest, the method comprising delivering to said locus a non-naturally occurring or engineered composition comprising a Type VI CRISPR-Cas loci effector protein and one or more nucleic acid components, wherein the effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised within a DNA molecule or within an RNA molecule. In a preferred embodiment, the target locus of interest comprises RNA.

The invention also provides a method of modifying a target locus of interest, the method comprising delivering to said locus a non-naturally occurring or engineered composition comprising a C2c2 loci effector protein and one or more nucleic acid components, wherein the C2c2 effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised in a nucleic acid molecule in vitro. In such methods the target locus of interest may be comprised in a nucleic acid molecule within a cell. Preferably, in such methods the target locus of interest may be comprised in a RNA molecule in vitro. Also preferably, in such methods the target locus of interest may be comprised in a RNA molecule within a cell. The cell may be a prokaryotic cell or a eukaryotic cell. The cell may be a mammalian cell. The cell may be a rodent cell. The cell may be a mouse cell.

In any of the described methods the target locus of interest may be a genomic or epigenomic locus of interest. In any of the described methods the complex may be delivered with multiple guides for multiplexed use. In any of the described methods more than one protein(s) may be used.

In further aspects of the invention the nucleic acid components may comprise a putative CRISPR RNA (crRNA) sequence. Without limitation, the Applicants hypothesize that in such instances, the pre-crRNA may comprise secondary structure that is sufficient for processing to yield the mature crRNA as well as crRNA loading onto the effector protein. By means of example and not limitation, such secondary structure may comprise, consist essentially of or consist of a stem loop within the pre-crRNA, more particularly within the direct repeat.

In any of the described methods the effector protein and nucleic acid components may be provided via one or more polynucleotide molecules encoding the protein and/or nucleic acid component(s), and wherein the one or more polynucleotide molecules are operably configured to express the protein and/or the nucleic acid component(s). The one or more polynucleotide molecules may comprise one or more regulatory elements operably configured to express the protein and/or the nucleic acid component(s). The one or more polynucleotide molecules may be comprised within one or more vectors. In any of the described methods the target locus of interest may be a genomic or epigenomic locus of interest. In any of the described methods the complex may be delivered with multiple guides for multiplexed use. In any of the described methods more than one protein(s) may be used.

In any of the described methods the strand break may be a single strand break or a double strand break.

Regulatory elements may comprise inducible promotors. Polynucleotides and/or vector systems may comprise inducible systems.

In any of the described methods the one or more polynucleotide molecules may be comprised in a delivery system, or the one or more vectors may be comprised in a delivery system.

In any of the described methods the non-naturally occurring or engineered composition may be delivered via liposomes, particles including nanoparticles, exosomes, microvesicles, a gene-gun or one or more viral vectors.

The invention also provides a non-naturally occurring or engineered composition which is a composition having the characteristics as discussed herein or defined in any of the herein described methods.

In certain embodiments, the invention thus provides a non-naturally occurring or engineered composition, such as particularly a composition capable of or configured to modify a target locus of interest, said composition comprising a Type VI CRISPR-Cas loci effector protein and one or more nucleic acid components, wherein the effector protein forms a complex with the one or more nucleic acid components and upon binding of the said complex to the locus of interest the effector protein induces the modification of the target locus of interest. In certain embodiments, the effector protein may be a C2c2 loci effector protein.

The invention also provides in a further aspect a non-naturally occurring or engineered composition, such as particularly a composition capable of or configured to modify a target locus of interest, said composition comprising: (a) a guide RNA molecule (or a combination of guide RNA molecules, e.g., a first guide RNA molecule and a second guide RNA molecule) or a nucleic acid encoding the guide RNA molecule (or one or more nucleic acids encoding the combination of guide RNA molecules); (b) a Type VI CRISPR-Cas loci effector protein or a nucleic acid encoding the Type VI CRISPR-Cas loci effector protein. In certain embodiments, the effector protein may be a C2c2 loci effector protein.

The invention also provides in a further aspect a non-naturally occurring or engineered composition comprising: (a) a guide RNA molecule (or a combination of guide RNA molecules, e.g., a first guide RNA molecule and a second guide RNA molecule) or a nucleic acid encoding the guide RNA molecule (or one or more nucleic acids encoding the combination of guide RNA molecules); (b) be a C2c2 loci effector protein.

The invention also provides a vector system comprising one or more vectors, the one or more vectors comprising one or more polynucleotide molecules encoding components of a non-naturally occurring or engineered composition which is a composition having the characteristics as defined in any of the herein described methods.

The invention also provides a delivery system comprising one or more vectors or one or more polynucleotide molecules, the one or more vectors or polynucleotide molecules comprising one or more polynucleotide molecules encoding components of a non-naturally occurring or engineered composition which is a composition having the characteristics discussed herein or as defined in any of the herein described methods.

The invention also provides a non-naturally occurring or engineered composition, or one or more polynucleotides encoding components of said composition, or vector or delivery systems comprising one or more polynucleotides encoding components of said composition for use in a therapeutic method of treatment. The therapeutic method of treatment may comprise gene or transcriptome editing, or gene therapy.

The invention also encompasses computational methods and algorithms to predict new Class 2 CRISPR-Cas systems and identify the components therein.

The invention also provides for methods and compositions wherein one or more amino acid residues of the effector protein may be modified e.g., an engineered or non-naturally-occurring effector protein or C2c2. In an embodiment, the modification may comprise mutation of one or more amino acid residues of the effector protein. The one or more mutations may be in one or more catalytically active domains of the effector protein. The effector protein may have reduced or abolished nuclease activity compared with an effector protein lacking said one or more mutations. The effector protein may not direct cleavage of one or other DNA or RNA strand at the target locus of interest. The effector protein may not direct cleavage of either DNA or RNA strand at the target locus of interest. In a preferred embodiment, the one or more mutations may comprise two mutations. In a preferred embodiment the one or more amino acid residues are modified in a C2c2 effector protein, e.g., an engineered or non-naturally-occurring effector protein or C2c2. In particular embodiments, the one or more modified of mutated amino acid residues are one or more of those in C2c2 corresponding to R597, H602, R1278 and H1283 (referenced to Lsh C2c2 amino acids and C2c2 consensus numbering), such as mutations R597A, H602A, R1278A and H1283A, or the corresponding amino acid residues in Lsh C2c2 orthologues.

In particular embodiments, the one or more modified of mutated amino acid residues are one or more of those in C2c2 corresponding to K2, K39, V40, E479, L514, V518, N524, G534, K535, E580, L597, V602, D630, F676, L709, 1713, R717 (HEPN), N718, H722 (HEPN), E773, P823, V828, 1879, Y880, F884, Y997, L1001, F1009, L1013, Y1093, L1099, L1111, Y1114, L1203, D1222, Y1244, L1250, L1253, K1261, 11334, L1355, L1359, R1362, Y1366, E1371, R1372, D1373, R1509 (HEPN), H1514 (HEPN), Y1543, D1544, K1546, K1548, V1551, 11558, according to C2c2 consensus numbering. In certain embodiments, the one or more modified of mutated amino acid residues are one or more of those in C2c2 corresponding to R717 and R1509. In certain embodiments, the one or more modified of mutated amino acid residues are one or more of those in C2c2 corresponding to K2, K39, K535, K1261, R1362, R1372, K1546 and K1548. In certain embodiments, said mutations result in a protein having an altered or modified activity. In certain embodiments, said mutations result in a protein having an increased activity, such as an increased specificity. In certain embodiments, said mutations result in a protein having a reduced activity, such as reduced specificity. In certain embodiments, said mutations result in a protein having no catalytic activity (i.e. "dead" C2c2). In an embodiment, said amino acid residues correspond to Lsh C2c2 amino acid residues, or the corresponding amino acid residues of a C2c2 protein from a different species.

The invention also provides for the one or more mutations or the two or more mutations to be in a catalytically active domain of the effector protein. In some embodiments of the invention the catalytically active domain may comprise a RuvCI, RuvCII or RuvCIII domain, or a catalytically active domain which is homologous to a RuvCI, RuvCII or RuvCIII domain etc or to any relevant domain as described in any of the herein described methods. In certain embodiments, the one or more mutations or the two or more mutations may be in a catalytically active domain of the effector protein comprising a HEPN domain, or a catalytically active domain which is homologous to a HEPN domain. The effector protein may comprise one or more heterologous functional domains. The one or more heterologous functional domains may comprise one or more nuclear localization signal (NLS) domains. The one or more heterologous functional domains may comprise at least two or more NLS domains. The one or more NLS domain(s) may be positioned at or near or in proximity to a terminus of the effector protein (e.g., C2c2) and if two or more NLSs, each of the two may be positioned at or near or in proximity to a terminus of the effector protein (e.g., C2c2). The one or more heterologous functional domains may comprise one or more translational activation domains. In other embodiments the functional domain may comprise a transcriptional activation domain, for example VP64. The one or more heterologous functional domains may comprise one or more transcriptional repression domains. In certain embodiments the transcriptional repression domain comprises a KRAB domain or a SID domain (e.g. SID4X). The one or more heterologous functional domains may comprise one or more nuclease domains. In a preferred embodiment a nuclease domain comprises Fok1.

The invention also provides for the one or more heterologous functional domains to have one or more of the following activities: methylase activity, demethylase activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity and nucleic acid binding activity. At least one or more heterologous functional domains may be at or near the amino-terminus of the effector protein and/or wherein at least one or more heterologous functional domains is at or near the carboxy-terminus of the effector protein. The one or more heterologous functional domains may be fused to the effector protein. The one or more heterologous functional domains may be tethered to the effector protein. The one or more heterologous functional domains may be linked to the effector protein by a linker moiety.

The invention also provides for the effector protein comprising an effector protein from an organism from a genus comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium* or *Acidaminococcus*. The effector protein may comprise a chimeric effector protein comprising a first fragment from a first effector protein ortholog and a second fragment from a second effector protein ortholog, and wherein the first and second effector protein orthologs are different. At least one of the first and second effector protein orthologs may comprise an effector protein from an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium* or *Acidaminococcus*.

In certain embodiments, the effector protein, particularly a Type V loci effector protein, more particularly a Type V-B loci effector protein, even more particularly a C2c1p, may originate from, may be isolated from or may be derived from a bacterial species belonging to the taxa Bacilli, Verrucomicrobia, alpha-proteobacteria or delta-proteobacteria. In certain embodiments, the effector protein, particularly a Type V loci effector protein, more particularly a Type V-B loci effector protein, even more particularly a C2c1p, may originate from, may be isolated from or may be derived from a bacterial species belonging to a genus selected from the group consisting of *Alicyclobacillus, Desulfovibrio, Desulfonatronum, Opitutaceae, Tuberibacillus, Bacillus, Brevibacillus, Desulfatirhabdium, Citrobacter*, and *Methylobacterium*. In certain embodiments, the effector protein, particularly a Type V loci effector protein, more particularly a Type V-B loci effector protein, even more particularly a C2c1p, may originate, may be isolated or may be derived from a bacterial species selected from the group consisting of *Alicyclobacillus acidoterrestris* (e.g., ATCC 49025), *Alicyclobacillus contaminans* (e.g., DSM 17975), *Desulfovibrio inopinatus* (e.g., DSM 10711), *Desulfonatronum thiodismutans* (e.g., strain MLF-1), Opitutaceae bacterium TAV5, Tuberibacillus calidus (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060). In certain embodiments, the effector protein, particularly a Type V loci effector protein, more particularly a Type V-B loci effector protein, even more particularly a C2c1p, may originate, may be isolated or may be derived from a bacterial species selected from the group consisting of the bacterial species listed in the Table in FIG. 41A-41B.

In certain embodiments, the effector protein, particularly a Type V loci effector protein, more particularly a Type V-B loci effector protein, even more particularly a C2c1p, may comprise, consist essentially of or consist of an amino acid sequence selected from the group consisting of amino acid sequences shown in the multiple sequence alignment in FIG. 13D-1-13H-2.

In certain embodiments, a Type V-B locus as intended herein may encode a Cas1-Cas4 fusion, Cas2, and the C2c1p effector protein. In certain embodiments, a Type V-B locus as intended herein may be adjacent to a CRISPR array. See FIG. 9 and FIG. 41A-41B for illustration of representative Type V-B loci organization.

In certain embodiments, a Cas1 protein encoded by a Type V-B locus as intended herein may cluster with Type I-U system. See FIGS. 10A and 10B and FIG. 10C-1-10W illustrating a Cas1 tree including Cas1 encoded by representative Type V-B loci.

In certain embodiments, the effector protein, particularly a Type V loci effector protein, more particularly a Type V-B loci effector protein, even more particularly a C2c1p, such as a native C2c1p, may be about 1100 to about 1500 amino acids long, e.g., about 1100 to about 1200 amino acids long, or about 1200 to about 1300 amino acids long, or about 1300 to about 1400 amino acids long, or about 1400 to about 1500 amino acids long, e.g., about 1100, about 1200, about 1300, about 1400 or about 1500 amino acids long.

In certain embodiments, the effector protein, particularly a Type V loci effector protein, more particularly a Type V-B loci effector protein, even more particularly a C2c1p, and preferably the C-terminal portion of said effector protein, comprises the three catalytic motifs of the RuvC-like nuclease (i.e., RuvCI, RuvCII and RuvCIII). In certain embodiments, said effector protein, and preferably the C-terminal portion of said effector protein, may further comprise a region corresponding to the bridge helix (also known as arginine-rich cluster) that in Cas9 protein is involved in crRNA-binding. In certain embodiments, said effector protein, and preferably the C-terminal portion of said effector protein, may further comprise a Zn finger region, which may be inactive (i.e., which does not bind zinc, e.g., in which the Zn-binding cysteine residue(s) are missing). In certain embodiments, said effector protein, and preferably the C-terminal portion of said effector protein, may comprise the three catalytic motifs of the RuvC-like nuclease (i.e., RuvCI, RuvCII and RuvCIII), the region corresponding to the bridge helix, and the Zn finger region, preferably in the following order, from N to C terminus: RuvCI-bridge helix-RuvCII-Zinc finger-RuvCIII. See FIG. 11, FIG. 12-1-12-2 and FIGS. 13A-1-13A-2 and 13C-1-13C-2 for illustration of representative Type V-B effector proteins domain architecture.

In certain embodiments, Type V-B loci as intended herein may comprise CRISPR repeats between 30 and 40 bp long, more typically between 34 and 38 bp long, even more typically between 36 and 37 bp long, e.g., 30, 31, 32, 33, 34, 35, 36, 37, 38, 39, or 40 bp long.

In certain embodiments, the effector protein, particularly a Type V loci effector protein, more particularly a Type V-C loci effector protein, even more particularly a C2c3p, may originate, may be isolated or may be derived from a bacterial metagenome selected from the group consisting of the bacterial metagenomes listed in the Table in FIG. 43A-43B.

In certain embodiments, the effector protein, particularly a Type V loci effector protein, more particularly a Type V-C loci effector protein, even more particularly a C2c3p, may comprise, consist essentially of or consist of an amino acid sequence selected from the group consisting of amino acid sequences shown in the multiple sequence alignment in FIG. 13I-1-13I-4.

In certain embodiments, a Type V-C locus as intended herein may encode Cas1 and the C2c3p effector protein. See FIG. 14 and FIG. 43A-43B for illustration of representative Type V-C loci organization.

In certain embodiments, a Cas1 protein encoded by a Type V-C locus as intended herein may cluster with Type I-B system. See FIGS. 10A and 10B and FIG. 10C-1-10W illustrating a Cas1 tree including Cas1 encoded by representative Type V-C loci.

In certain embodiments, the effector protein, particularly a Type V loci effector protein, more particularly a Type V-C loci effector protein, even more particularly a C2c3p, such as a native C2c3p, may be about 1100 to about 1500 amino acids long, e.g., about 1100 to about 1200 amino acids long, or about 1200 to about 1300 amino acids long, or about 1300 to about 1400 amino acids long, or about 1400 to about 1500 amino acids long, e.g., about 1100, about 1200, about 1300, about 1400 or about 1500 amino acids long, or at least about 1100, at least about 1200, at least about 1300, at least about 1400 or at least about 1500 amino acids long.

In certain embodiments, the effector protein, particularly a Type V loci effector protein, more particularly a Type V-C loci effector protein, even more particularly a C2c3p, and preferably the C-terminal portion of said effector protein, comprises the three catalytic motifs of the RuvC-like nuclease (i.e., RuvCI, RuvCII and RuvCIII). In certain embodiments, said effector protein, and preferably the C-terminal portion of said effector protein, may further comprise a region corresponding to the bridge helix (also known as arginine-rich cluster) that in Cas9 protein is involved in crRNA-binding. In certain embodiments, said effector protein, and preferably the C-terminal portion of said effector protein, may further comprise a Zn finger region. Preferably, the Zn-binding cysteine residue(s) may be conserved in C2c3p. In certain embodiments, said effector protein, and preferably the C-terminal portion of said effector protein, may comprise the three catalytic motifs of the RuvC-like nuclease (i.e., RuvCI, RuvCII and RuvCIII), the region corresponding to the bridge helix, and the Zn finger region, preferably in the following order, from N to C terminus: RuvCI-bridge helix-RuvCII-Zinc finger-RuvCIII. See FIGS. 13A-1-13A-2 and 13C-1-13C-2 for illustration of representative Type V-C effector proteins domain architecture. In particular embodiments, said effector protein may comprise two HEPN catalytic motifs as illustrated in FIG. 97(A).

In certain embodiments, Type V-C loci as intended herein may comprise CRISPR repeats between 20 and 30 bp long, more typically between 22 and 27 bp long, yet more typically 25 bp long, e.g., 20, 21, 22, 23, 24, 25, 26, 27, 28, 29, or 30 bp long.

In certain embodiments, the effector protein, particularly a Type VI loci effector protein, more particularly a C2c2p, may originate from, may be isolated from, or may be derived from a bacterial species belonging to the taxa alpha-proteobacteria, Bacilli, Clostridia, Fusobacteria and Bacteroidetes. In certain embodiments, the effector protein, particularly a Type VI loci effector protein, more particularly a C2c2p, may originate from, may be isolated from, or may be derived from a bacterial species belonging to a genus selected from the group consisting of Lachnospiraceae, *Clostridium, Carnobacterium, Paludibacter, Listeria, Leptotrichia,* and *Rhodobacter*. In certain embodiments, the effector protein, particularly a Type VI loci effector protein, more particularly a C2c2p may originate from, may be isolated from or may be derived from a bacterial species selected from the group consisting of Lachnospiraceae bacterium MA2020, Lachnospiraceae bacterium NK4A179, *Clostridium aminophilum* (e.g., DSM 10710), Lachnospiraceae bacterium NK4A144, *Carnobacterium gallinarum* (e.g., DSM 4847 strain MT44), *Paludibacter propionicigenes* (e.g., WB4), *Listeria seeligeri* (e.g., serovar % b str. SLCC3954), *Listeria weihenstephanensis* (e.g., FSL R9-0317 c4), *Listeria newyorkensis* (e.g., strain FSL M6-0635), *Leptotrichia wadei* (e.g., F0279), *Leptotrichia buccalis* (e.g., DSM 1135), *Leptotrichia* sp. Oral taxon 225 (e.g., str. F0581), *Leptotrichia* sp. Oral taxon 879 (e.g., strain F0557), *Leptotrichia shahii* (e.g., DSM 19757), *Rhodobacter capsulatus* (e.g., SB 1003, R121, or DE442). In certain embodiments, the effector protein, particularly a Type VI loci effector protein, more particularly a C2c2p may originate from, may be isolated from or may be derived from a bacterial species selected from the group consisting of the bacterial species listed in the Table in FIG. 42A-42B. In particular embodiments, the C2c2 protein originates from *Leptotrichia shahii* (e.g., DSM 19757).

In certain embodiments, the effector protein, particularly a Type VI loci effector protein, more particularly a C2c2p, may comprise, consist essentially of or consist of an amino acid sequence selected from the group consisting of amino acid sequences shown in the multiple sequence alignment in FIG. 13J-1-13N-4 or more particularly from the group consisting of amino acid sequences shown in the sequence alignment in FIG. 110.

In certain embodiments, a Type VI locus as intended herein may encode Cas1, Cas2, and the C2c2p effector protein. In certain embodiments, a Type V-C locus as intended herein may comprise a CRISPR array. In certain embodiments, a Type V-C locus as intended herein may comprise the c2c2 gene and a CRISPR array, and not comprise cas1 and cas2 genes. See FIG. 15 and FIG. 42A-42B for illustration of representative Type VI loci organization.

In certain embodiments, a Cas1 protein encoded by a Type VI locus as intended herein may cluster within the Type II subtree along with a small Type III-A branch, or within Type III-A system. See FIGS. 10A and 10B and FIG. 10C-1-10W illustrating a Cas1 tree including Cas1 encoded by representative Type VI loci.

In certain embodiments, the effector protein, particularly a Type VI loci effector protein, more particularly a C2c2p, such as a native C2c2p, may be about 1000 to about 1500 amino acids long, such as about 1100 to about 1400 amino acids long, e.g., about 1000 to about 1100, about 1100 to about 1200 amino acids long, or about 1200 to about 1300 amino acids long, or about 1300 to about 1400 amino acids long, or about 1400 to about 1500 amino acids long, e.g., about 1000, about 1100, about 1200, about 1300, about 1400 or about 1500 amino acids long.

In certain embodiments, the effector protein, particularly a Type VI loci effector protein, more particularly a C2c2p, comprises at least one and preferably at least two, such as more preferably exactly two, conserved RxxxxH motifs. Catalytic RxxxxH motifs are are characteristic of HEPN (Higher Eukaryotes and Prokaryotes Nucleotide-binding) domains. Hence, in certain embodiments, the effector protein, particularly a Type VI loci effector protein, more particularly a C2c2p, comprises at least one and preferably at least two, such as more preferably exactly two, HEPN domains. See FIG. 11 and FIG. 13B and FIG. 11O for illustration of representative Type VI effector proteins domain architecture. In certain embodiments, the HEPN domains may possess RNAse activity. In other embodiments, the HEPN domains may possess DNAse activity.

In certain embodiments, Type VI loci as intended herein may comprise CRISPR repeats between 30 and 40 bp long, more typically between 35 and 39 bp long, e.g., 30, 31, 32, 33, 34, 35, 36, 37, 38, 39, or 40 bp long. In particular embodiments, the direct repeat is at least 25 nt long.

In certain embodiments, a protospacer adjacent motif (PAM) or PAM-like motif directs binding of the effector protein complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). The term "PAM" may be used interchangeably with the term "PFS" or "protospacer flanking site" or "protospacer flanking sequence".

In a preferred embodiment, the effector protein, particularly a Type V loci effector protein, more particularly a Type V-B loci effector protein, even more particularly a C2c1p, may recognize a 5' PAM. In certain embodiments, the effector protein, particularly a Type V loci effector protein, more particularly a Type V-B loci effector protein, even more particularly a C2c1p, may recognize a 5' PAM which is 5' TTN or 5' ATTN, where N is A, C, G or T. In certain preferred embodiments, the effector protein may be *Alicyclobacillus acidoterrestris* C2c1p, more preferably *Alicyclobacillus acidoterrestris* ATCC 49025 C2cp, and the 5' PAM is 5' TTN, where N is A, C, G or T, more preferably where N is A, G or T. In other preferred embodiments, the effector protein is *Bacillus thermoamylovorans* C2c1p, more preferably *Bacillus thermoamylovorans* strain B4166 C2c1p, and the 5' PAM is 5' ATTN, where N is A, C, G or T.

In a preferred embodiment, the effector protein, particularly a Type VI loci effector protein, more particularly a C2c2p, may recognize a 3' PAM. In certain embodiments, the effector protein, particularly a Type VI loci effector protein, more particularly a C2c2p, may recognize a 3' PAM which is 5'H, wherein H is A, C or U. In certain preferred embodiments, the effector protein may be *Leptotrichia shahii* C2c2p, more preferably *Leptotrichia shahii* DSM 19757 C2c2, and the 5' PAM is a 5' H.

In certain embodiments, the CRISPR enzyme is engineered and can comprise one or more mutations that reduce or eliminate a nuclease activity. Mutations can also be made at neighboring residues, e.g., at amino acids near those indicated above that participate in the nuclease activity. In some embodiments, only one HEPN domain is inactivated, and in other embodiments, a second HEPN domain is inactivated.

In certain embodiments of the invention, the guide RNA or mature crRNA comprises, consists essentially of, or consists of a direct repeat sequence and a guide sequence or spacer sequence. In certain embodiments, the guide RNA or mature crRNA comprises, consists essentially of, or consists of a direct repeat sequence linked to a guide sequence or spacer sequence. In certain embodiments the guide RNA or mature crRNA comprises 19 nts of partial direct repeat followed by 18, 19, 20, 21, 22, 23, 24, 25, or more nt of guide sequence, such as 18-25, 19-25, 20-25, 21-25, 22-25, or 23-25 nt of guide sequence or spacer sequence. In certain embodiments, the effector protein is a C2c2 effector protein and requires at least 16 nt of guide sequence to achieve detectable DNA cleavage and a minimum of 17 nt of guide sequence to achieve efficient DNA cleavage in vitro. In particular embodiments, the effector protein is a C2c2 protein and requires at least 19 nt of guide sequence to achieve detectable RNA cleavage. In certain embodiments, the direct repeat sequence is located upstream (i.e., 5') from the guide sequence or spacer sequence. In a preferred embodiment the seed sequence (i.e. the sequence essential critical for recognition and/or hybridization to the sequence at the target locus) of the C2c2 guide RNA is approximately within the first 5 nt on the 5' end of the guide sequence or spacer sequence.

In preferred embodiments of the invention, the mature crRNA comprises a stem loop or an optimized stem loop structure or an optimized secondary structure. In preferred embodiments the mature crRNA comprises a stem loop or an optimized stem loop structure in the direct repeat sequence, wherein the stem loop or optimized stem loop structure is important for cleavage activity. In certain embodiments, the mature crRNA preferably comprises a single stem loop. In certain embodiments, the direct repeat sequence preferably comprises a single stem loop. In certain embodiments, the cleavage activity of the effector protein complex is modified by introducing mutations that affect the stem loop RNA duplex structure. In preferred embodiments, mutations which maintain the RNA duplex of the stem loop may be introduced, whereby the cleavage activity of the effector protein complex is maintained. In other preferred embodiments, mutations which disrupt the RNA duplex structure of the stem loop may be introduced, whereby the cleavage activity of the effector protein complex is completely abolished.

In particular embodiments, the C2c2 protein is an Lsh C2c2 effector protein and the mature crRNA comprises a stem loop or an optimized stem loop structure. In particular embodiments, the direct repeat of the crRNA comprises at least 25 nucleotides comprising a stem loop. In particular embodiments, the stem is amenable to individual base swaps but activity is disrupted by most secondary structure changes or truncation of the crRNA. Examples of disrupting mutations include swapping of more than two of the stem nucleotides, addition of a non-pairing nucleotide in the stem, shortening of the stem (by removal of one of the pairing nucleotides) or extending the stem (by addition of one set of pairing nucleotides). However, the crRNA may be amenable to 5' and/or 3' extensions to include non-functional RNA sequences as envisaged for particular applications described herein.

The invention also provides for the nucleotide sequence encoding the effector protein being codon optimized for expression in a eukaryote or eukaryotic cell in any of the herein described methods or compositions. In an embodiment of the invention, the codon optimized nucleotide sequence encoding the effector protein encodes any C2c2 discussed herein and is codon optimized for operability in a eukaryotic cell or organism, e.g., such cell or organism as elsewhere herein mentioned, for instance, without limitation, a yeast cell, or a mammalian cell or organism, including a mouse cell, a rat cell, and a human cell or non-human eukaryote organism, e.g., plant.

In certain embodiments of the invention, at least one nuclear localization signal (NLS) is attached to the nucleic acid sequences encoding the C2c2 effector proteins. In preferred embodiments at least one or more C-terminal or N-terminal NLSs are attached (and hence nucleic acid molecule(s) coding for the C2c2 effector protein can include coding for NLS(s) so that the expressed product has the NLS(s) attached or connected). In certain embodiments of the invention, at least one nuclear export signal (NES) is attached to the nucleic acid sequences encoding the C2c2 effector proteins. In preferred embodiments at least one or more C-terminal or N-terminal NESs are attached (and hence nucleic acid molecule(s) coding for the C2c2 effector protein can include coding for NES(s) so that the expressed product has the NES(s) attached or connected). In a preferred embodiment a C-terminal and/or N-terminal NLS or NES is attached for optimal expression and nuclear targeting in eukaryotic cells, preferably human cells. In a preferred embodiment, the codon optimized effector protein is C2c2 and the spacer length of the guide RNA is from 15 to 35 nt. In certain embodiments, the spacer length of the guide RNA is at least 16 nucleotides, such as at least 17 nucleotides, preferably at least 18 nt, such as preferably at least 19 nt, at least 20 nt, at least 21 nt, or at least 22 nt. In certain embodiments, the spacer length is from 15 to 17 nt, from 17 to 20 nt, from 20 to 24 nt, eg. 20, 21, 22, 23, or 24 nt, from 23 to 25 nt, e.g., 23, 24, or 25 nt, from 24 to 27 nt, from 27-30 nt, from 30-35 nt, or 35 nt or longer. In certain embodiments of the invention, the codon optimized effector protein is C2c2 and the direct repeat length of the guide RNA is at least 16 nucleotides. In certain embodiments, the codon optimized effector protein is C2c2 and the direct repeat length of the guide RNA is from 16 to 20 nt, e.g., 16, 17, 18, 19, or 20 nucleotides. In certain preferred embodiments, the direct repeat length of the guide RNA is 19 nucleotides.

The invention also encompasses methods for delivering multiple nucleic acid components, wherein each nucleic acid component is specific for a different target locus of interest thereby modifying multiple target loci of interest. The nucleic acid component of the complex may comprise one or more protein-binding RNA aptamers. The one or more aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

In a further aspect, the invention provides a eukaryotic cell comprising a nucleotide sequence encoding the CRISPR system described herein which ensures the generation of a modified target locus of interest, wherein the target locus of interest is modified according to in any of the herein described methods. A further aspect provides a cell line of said cell. Another aspect provides a multicellular organism comprising one or more said cells.

In certain embodiments, the modification of the target locus of interest may result in: the eukaryotic cell comprising altered expression of at least one gene product; the eukaryotic cell comprising altered expression of at least one gene product, wherein the expression of the at least one gene product is increased; the eukaryotic cell comprising altered expression of at least one gene product, wherein the expression of the at least one gene product is decreased; or the eukaryotic cell comprising an edited genome.

In certain embodiments, the eukaryotic cell may be a mammalian cell or a human cell.

In further embodiments, the non-naturally occurring or engineered compositions, the vector systems, or the delivery systems as described in the present specification may be used for RNA sequence-specific interference, RNA sequence specific modulation of expression (inluding isoform specific expression), stability, localization, functionality (e.g. ribosomal RNAs or miRNAs), etc; or multiplexing of such processes.

In further embodiments, the the non-naturally occurring or engineered compositions, the vector systems, or the delivery systems as described in the present specification may be used for RNA detection and/or quantification within a cell.

In further embodiments, the the non-naturally occurring or engineered compositions, the vector systems, or the delivery systems as described in the present specification may be used for generating disease models and/or screening systems.

In further embodiments, the non-naturally occurring or engineered compositions, the vector systems, or the delivery systems as described in the present specification may be used for: site-specific transcriptome editing or purturbation; nucleic acid sequence-specific interference; or multiplexed genome engineering.

Also provided is a gene product from the cell, the cell line, or the organism as described herein. In certain embodiments, the amount of gene product expressed may be greater than or less than the amount of gene product from a cell that does not have altered expression or edited genome. In certain embodiments, the gene product may be altered in comparison with the gene product from a cell that does not have altered expression or edited genome.

These and other embodiments are disclosed or are obvious from and encompassed by, the following Detailed Description.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 1B provides another depiction of the new classification of CRISPR-Cas systems.

FIG. 4 shows CRISPR-Cas as a RNA recognition motif (RRM)-centered system.

FIG. 8B provides another depiction of an organization of complete loci of several Class 2 CRISPR-Cas systems.

FIGS. 10A and 10B depict representations of a Cas1 tree. The tree in FIG. 10B was constructed from a multiple alignment of 1498 Cas1 sequences which contained 304 phylogenetically informative positions. Branches, corresponding to Class 2 systems are highlighted: type II; subtype V-A; subtype V-B; subtype V-C; type VI. Insets show the expanded branches of the novel (sub)types. The bootstrap support values are given as percentage points and shown only for few relevant branches.

FIGS. 10C-1-10W. FIGS. 10C-1-10W provide the complete Cas1 tree, which is schematically shown in FIG. 10B, in Newick format with species names and bootstrap support values. The tree was reconstructed by FastTree program ("-gamma-wag" options). A multiple alignment of Cas1 sequences was filtered with homogeneity threshold of 0.1 and gap occurrence threshold of 0.5, prior to tree reconstruction.

FIG. 12-1-12-2 depicts TnpB homology regions in Class 2 proteins. Figure discloses SEQ ID NOS 202-384, respectively, in order of appearance.

Figure 13I-4:
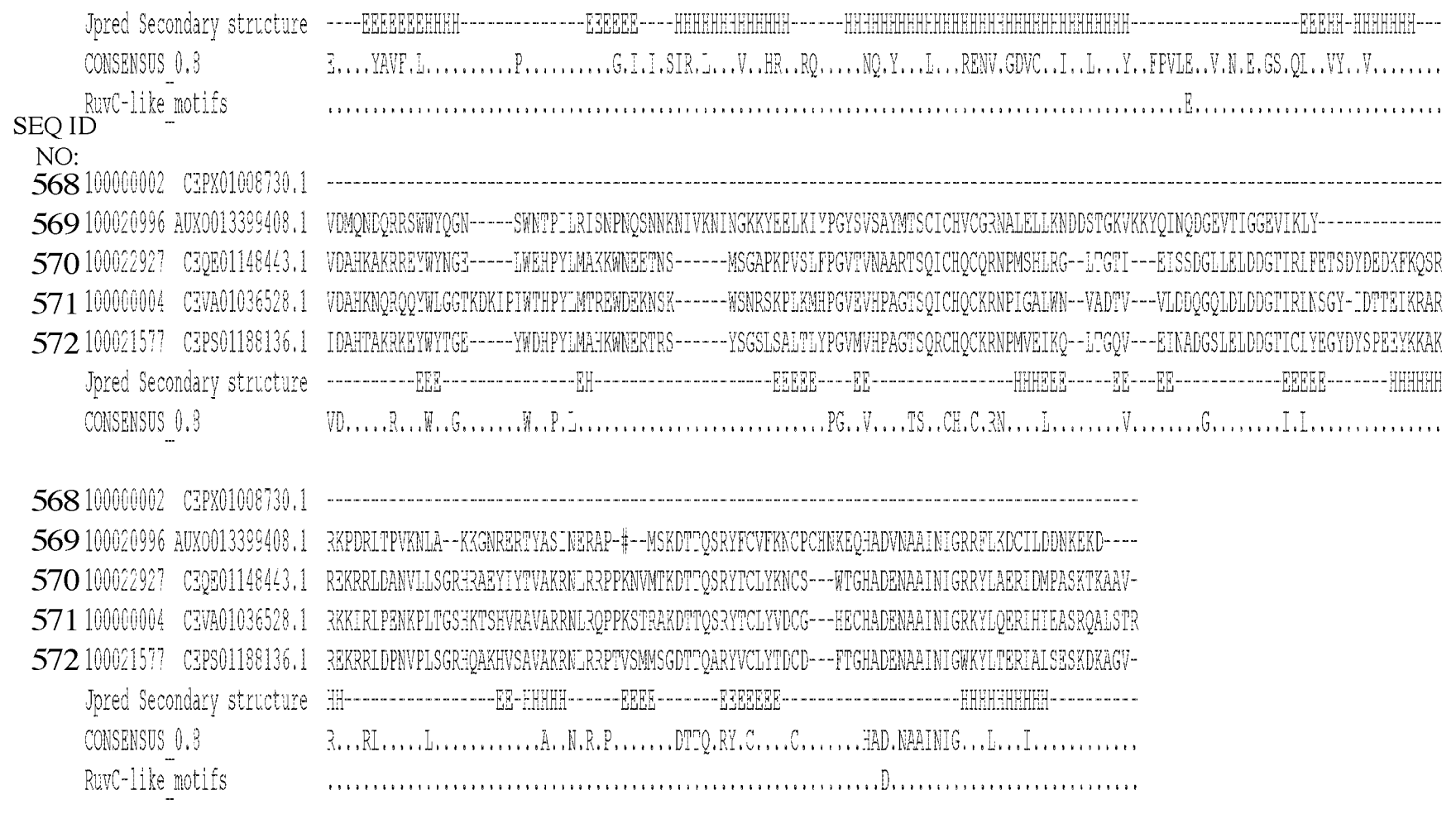
Figure 13J-1:
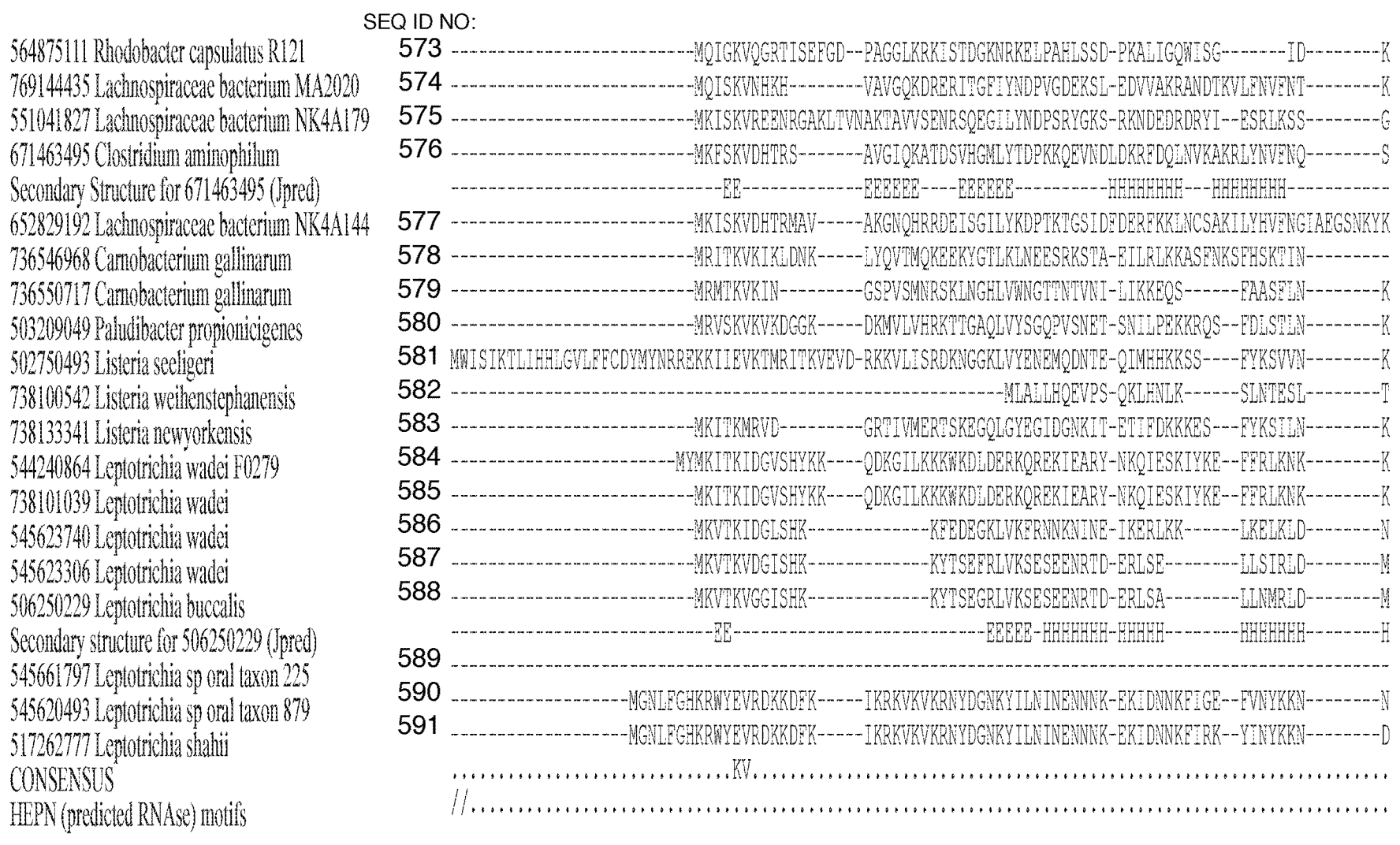
Figure 13J-3:
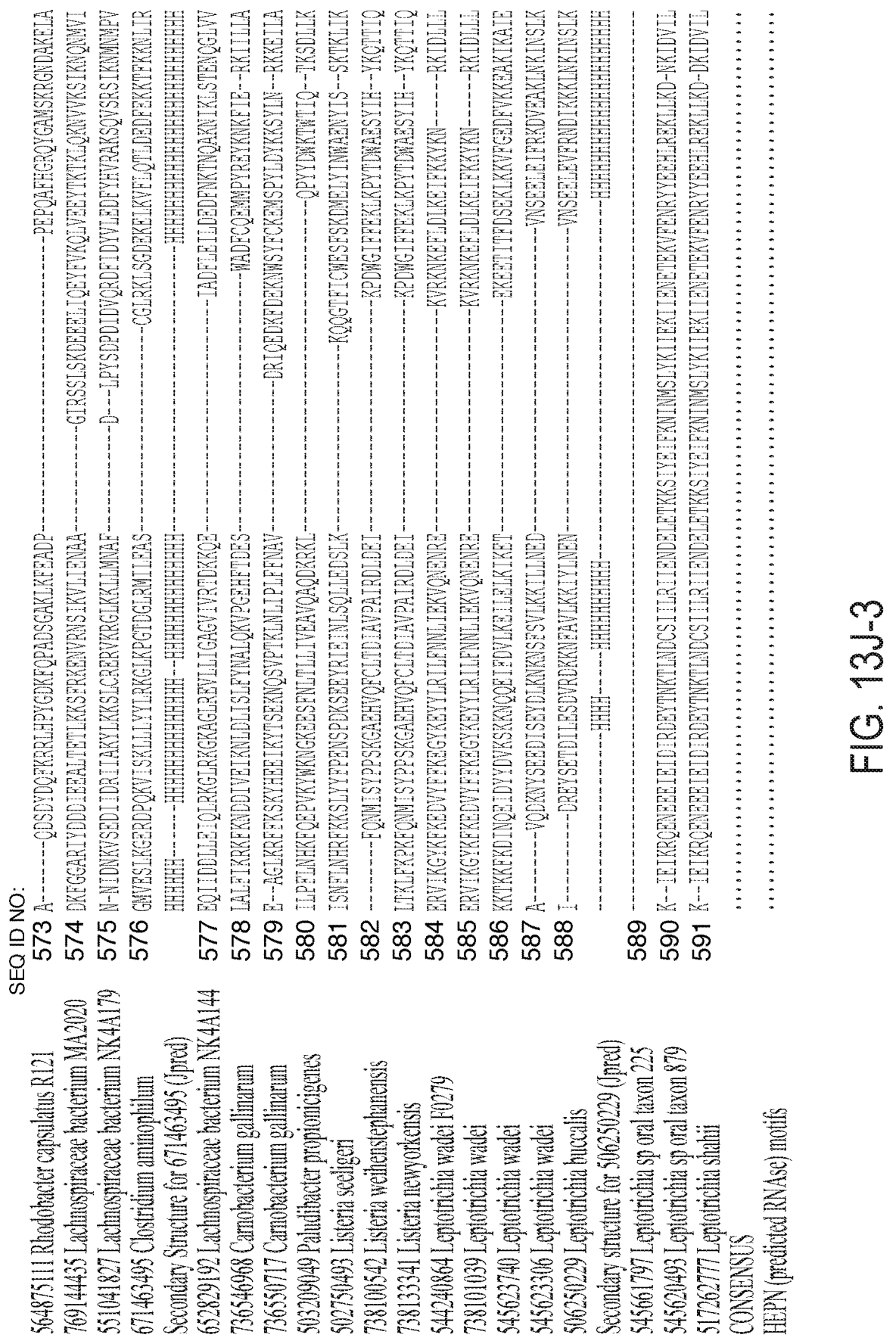
Figure 13K-3:
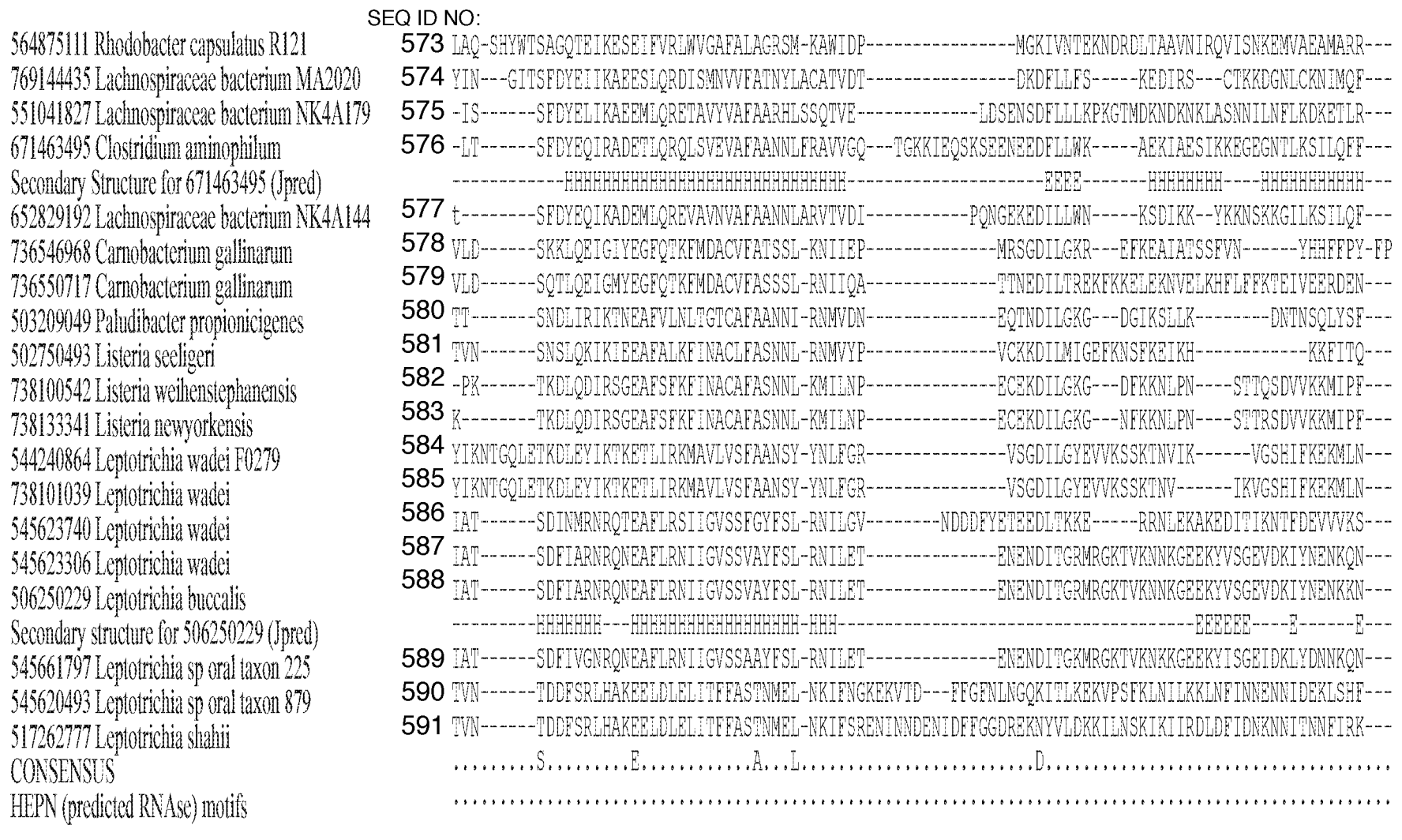
Figure 13L-4:
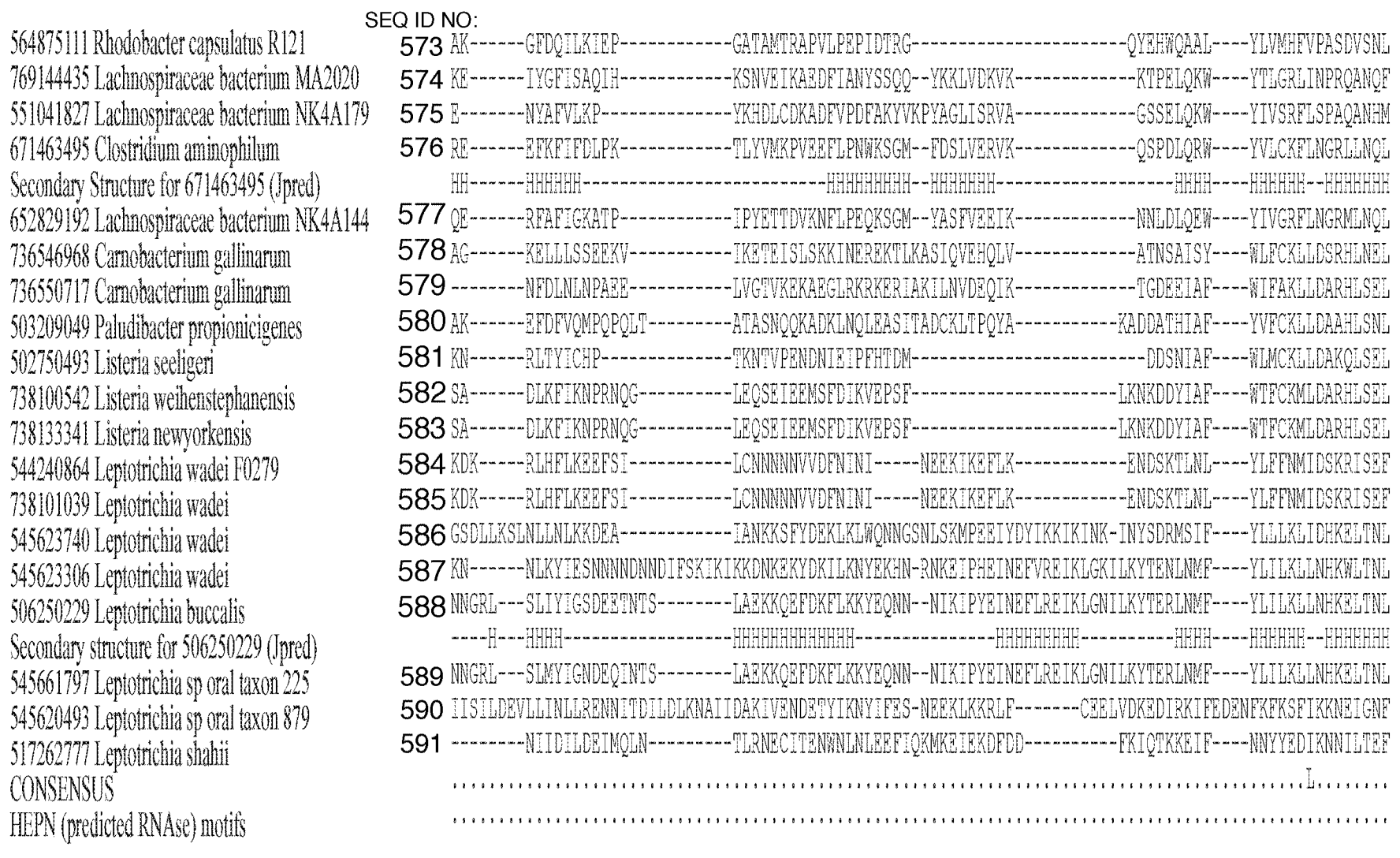
Figure 13M-1:
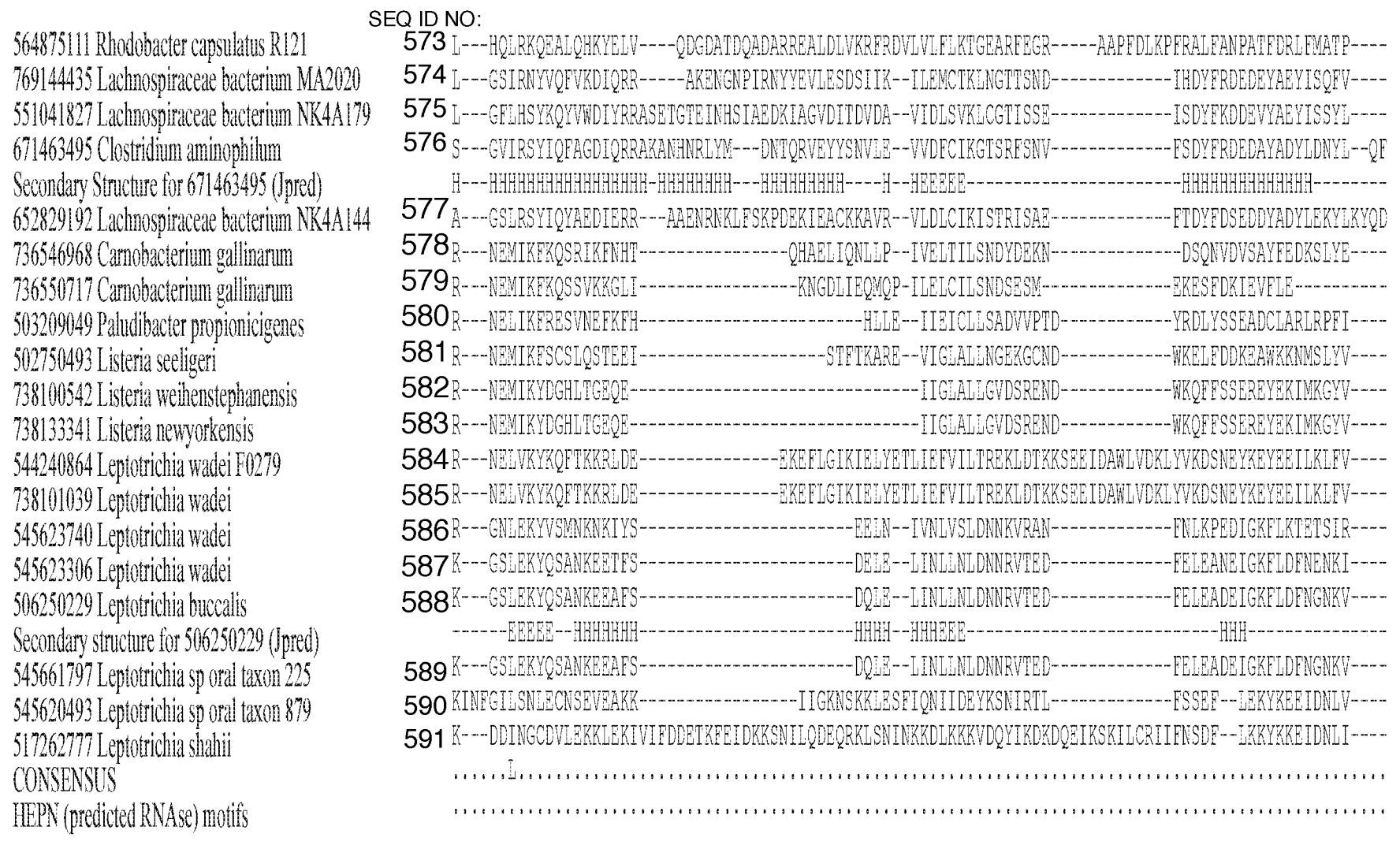
Figure 13N-1:
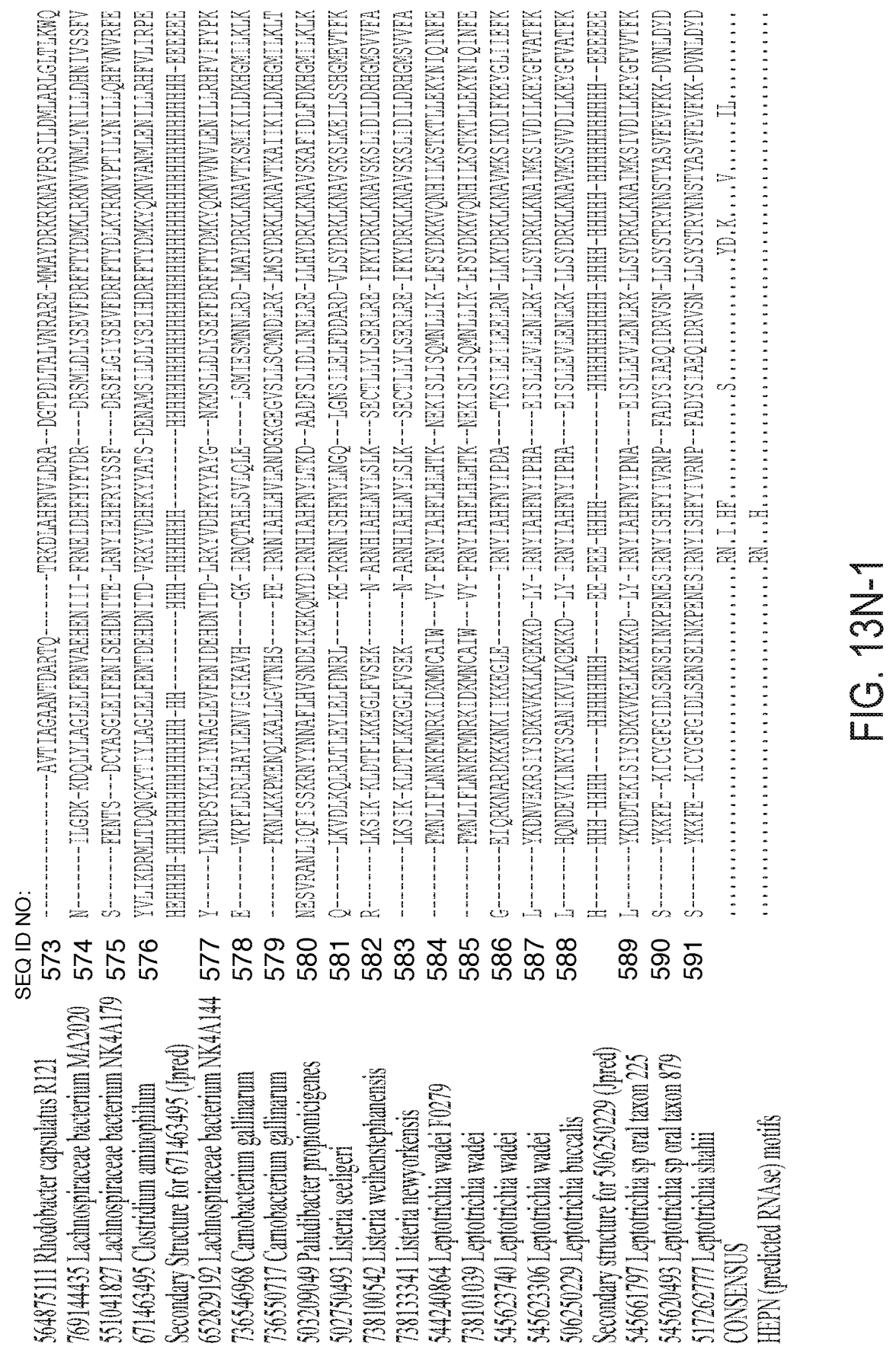

FIGS. 13A-1-13N-4. FIGS. 13A-1-13A-2 and 13B provide another depiction of domain architectures and conserved motifs of the Class 2 effector proteins. FIGS. 13A-1-13A-2 illustrates Types II and V: TnpB-derived nucleases. The top panel shows the RuvC nuclease from *Thermos thermophilus* (PDB ID: 4EP5) with the catalytic amino acid residues denoted. Underneath each domain architecture, an alignment of the conserved motifs in selected representatives of the respective protein family (a single sequence for RuvC) is shown. The catalytic residues are shown by white letters on a black background; conserved hydrophobic residues are highlighted; conserved small residues are highlighted; in the bridge helix alignment, positively charged residues are highlighted. Secondary structure prediction is shown underneath the aligned sequences: H denotes α-helix and E denotes extended conformation (β-strand). The poorly conserved spacers between the alignment blocks are shown by numbers. FIG. 13B illustrates Type VI: proteins containing two HEPN domains, which may display RNAse activity. The top alignment blocks include selected HEPN domains described previously and the bottom blocks include the catalytic motifs from the type VI effector proteins. The designations are as in FIG. 13A-1-13A-2. FIG. 13C-1-13C-2 shows the closest homologs of the new type V effector proteins among the transposon-encoded proteins: non-overlapping sets of homologs. FIG. 13D-1-13H-2 shows multiple alignment of C2c1 protein family. The alignment was built using MUSCLE program and modified manually on the basis of local PSI-BLAST pairwise alignments. Each sequence is labelled with GenBank Identifier (GI) number and systematic name of an organism. Secondary structure was predicted by Jpred and shown underneath the sequence which was used as a query (designations: H—alpha helix, E—beta strand). CONSENSUS was calculated for each alignment column by scaling the sum-of-pairs score within the column between those of a homogeneous column (the same residue in all aligned sequences) and a random column with homogeneity cutoff 0.8. Active site motifs of RuvC-like domain are shown below alignment. FIG. 13I-1-13I-4 shows multiple alignment of C2c3 protein family. The alignment was built using MUSCLE program. Each sequence is labelled with local assigned number and the Genbank ID for metagenomics contig coding for respective C2c3 protein. Secondary structure was predicted by Jpred and shown underneath the alignment (designations: H—alpha helix, E—beta strand). CONSENSUS was calculated for each alignment column by scaling the sum-of-pairs score within the column between those of a homogeneous column (the same residue in all aligned sequences) and a random column with homogeneity cutoff 0.8. Active site motifs of RuvC-like domain are shown below alignment for the C-terminal domain. FIG. 13J-1-13N-4 shows multiple alignment of C2c2 protein family. The alignment was built using MUSCLE program and modified manually on the basis of local PSIBLAST pairwise alignments. Each sequence is labelled with GenBank Identifier (GI) number and systematic name of an organism. Secondary structure was predicted by Jpred and shown underneath the sequence which was used as a query (designations: H—alpha helix, E—beta strand). CONSENSUS was calculated for each alignment column by scaling the sum-of-pairs score within the column between those of a homogeneous column (the same residue in all aligned sequences) and a random column with homogeneity cutoff 0.8. Active site motifs of HEPN domain are shown below alignment. FIG. 13A-1-13A-2 discloses SEQ ID NOS 385-503, respectively, in order of appearance. FIG. 13B discloses SEQ ID NOS 504-547, respectively, in order of appearance. FIGS. 13D-1-13H-2 disclose SEQ ID NOS 548-567, respectively, in order of appearance. FIG. 13I-1-13I-4 discloses SEQ ID NOS 568, 569 & 1786, and 570-572, respectively, in order of appearance. FIGS. 13J-1-13N-4 disclose SEQ ID NOS 573-591, respectively, in order of appearance.

FIG. 16-1-16-8 depicts HEPN RxxxxH motif in C2c2 family. Figure discloses SEQ ID NOS 592-1195, respectively, in order of appearance.

FIG. 19 depicts C2C1: 5. *Opitutaceae bacterium* TAV5. Figure discloses SEQ ID NOS 1204-1207, respectively, in order of appearance.

FIG. 21 depicts C2C1: 9. *Bacillus* sp. NSP2.1. Figure discloses SEQ ID NOS 1212-1215, respectively, in order of appearance.

FIG. 23-1-23-2 depicts C2C2: 2. Lachnospiraceae bacterium NK4A179. Figure discloses SEQ ID NO: 2233, and SEQ ID NOS 1220-122 and 1224-1226, respectively, in order of appearance.

FIG. 27-1-27-2 depicts C2C2: 6. *Carnobacterium gallinarum* DSM 4847. Figure discloses SEQ ID NOS 1237-1243, respectively, in order of appearance.

FIG. 31-1-31-2 depicts C2C2: 10. *Listeria bacterium* FSL M6-0635. Figure discloses SEQ ID NOS 1250-1253, respectively, in order of appearance.

FIG. 32 depicts C2C2: 11. *Leptotrichia wadei* F0279. Figure discloses SEQ ID NO: 1254.

FIG. 33-1-33-2 depicts C2C2: 12. *Leptotrichia wadei* F0279. Figure discloses SEQ ID NOS 1255-1261, respectively, in order of appearance.

FIGS. 40A-40D shows the Table listing 63 large protein-coding genes identified using the computational pipeline disclosed herein in the vicinity of cas genes. Representatives of the new subtypes disclosed herein (V-B, V-C, VI) are colored. Protein sequences for AUXO014641567.1, AUXO011689375.1, AUXO011689375.1, AUXO011277409.1, AUXO014986615.1 coding representatives of Type V-B and Type IV were not analyzed, since species affiliation cannot be assigned to these sequences.

FIGS. 41A-41M-2. FIGS. 41A-B shows the Table presenting the analysis of Type V-B (C2c1 protein-encoding) loci. * cas1cas4—gene containing cas4 and cas1 domains; CRISPR—CRISPR repeat; SOS—SOS response gene; unk—hypothetical protein; >—direction of gene coding sequence; [D]—degenerate repeat (defined where it was possible); [T]—tracrRNA. FIG. 41C-41J shows CRISPR arrays analysis of Type V-B (C2c protein-encoding) loci as disclosed herein (CRISPR section is basic output of pilercr (see pilercr site for description of output: drive5.com/pilercr/); repeat folding was done with mfold (see mfold site for description of output: albany.edu/?q=mfold/DNA-Folding-Form); repeat folding and CRISPRS array are placed after detailed description of each case; for CRISPR location see link in the Table in FIG. 41A-41B). FIG. 41K shows CRISPRmap classification of CRISPR repeats of Type V-B (C2c1 protein-encoding) loci as disclosed herein using CRISPRmap (see uni-freiburg.de/CRISPRmap for details). FIG. 41L shows degenerate repeats of Type V-B (C2c1 protein-encoding) loci as disclosed herein found using CRISPRs finder (u-psud.fr/Server/). Normal repeat column contains normal repeat, spacer—the last spacer, downstream—downstream region starting from degenerate repeat (250 bp); array number corresponds to the number of CRISPR array in the respective locus (see the Table in FIG. 41A-41B); region highlighted has a perfect match between normal repeat and degenerate repeat (other part of degenerate repeat does not match). FIG. 41M-1-41M-2 shows predicted structures of tracrRNAs base-paired with the repeats. TracrRNA for *Alicyclobacillus acidoterrestric* was identified using RNAseq. For the remaining loci, putative tracrRNAs were identified based on presence of an anti-direct repeat (DR) sequence. Anti-DRs were identified using Geneious (geneious.com) by searching for sequences within each respective CRISPR locus that are highly homologus to DR. The 5' and 3' ends of each putative tracrRNA was determined though computational prediction of bacterial transcription start and termination sites using BPROM (softberry.com) and ARNOLD (u-psud.fr/toolbox/arnold/)

respectively. Co-folding predictions were generated using Geneious. 5' ends are colored dark gray and 3' ends are colored gray. FIG. 41C discloses SEQ ID NOS 1272-1278, 2229, 1280-1284, 2230, and 1287-1311, respectively, in order of appearance. FIG. 41D discloses SEQ ID NOS 1312-1319, respectively, in order of appearance. FIG. 41E discloses SEQ ID NOS 1320-1326, respectively, in order of appearance. FIG. 41F discloses SEQ ID NOS 1327-1367, respectively, in order of appearance. FIG. 41G discloses SEQ ID NOS 1368-1406, respectively, in order of appearance. FIG. 41H discloses SEQ ID NOS 1407-1424, respectively, in order of appearance. FIG. 41I discloses SEQ ID NOS 1425-1460, respectively, in order of appearance. FIG. 41J discloses SEQ ID NOS 1461-1471, respectively, in order of appearance. FIG. 41K discloses SEQ ID NOS 1472-1489, respectively, in order of appearance. FIG. 41L discloses the "Repeat" sequences as SEQ ID NOS 1490-1499, the "Spacer" sequences as SEQ ID NOS 1500-1509, and the "Downstream" sequences as SEQ ID NOS 1510-1519, all respectively, in order of appearance. FIG. 41L also discloses SEQ ID NO: 1520 below the table. FIG. 41M-1-41-M-2 discloses SEQ ID NOS 1521-1528, respectively, in order of appearance.

FIG. 42A-42N-2. FIG. 42A-42B shows the Table presenting the analysis of Type VI (C2c2 protein-encoding) loci. * CRISPR—CRISPR repeat; unk—hypothetical protein; >—direction of gene coding sequence; [D]—degenerate repeat (defined where it was possible); [T]—tracrRNA. FIG. 42C-1-42I-3 shows CRISPR arrays analysis of Type VI (C2c2 protein-encoding) loci as disclosed herein (CRISPR section is basic output of pilercr (see pilercr site for description of output: drive5.com/pilercr/); repeat folding was done with mfold (see mfold site for description of output: albany.edu/?q=mfold/DNA-Folding-Form); repeat folding and CRISPRS array are placed after detailed description of each case; for CRISPR location see link in the Table in FIG. 42A-42B). FIG. 42J-1-42J-2 shows CRISPRmap classification of CRISPR repeats of Type VI (C2c2 protein-encoding) loci as disclosed herein using CRISPRmap (see uni-freiburg.de/CRISPRmap/for details). FIG. 42K-1-L shows degenerate repeats of Type VI (C2c2 protein-encoding) loci as disclosed herein found using CRISPRs finder (psud.fr/Server/). Normal repeat column contains normal repeat, spacer—the last spacer, downstream—downstream region starting from degenerate repeat (250 bp); array number corresponds to the number of CRISPR array in the respective locus (see the Table in FIG. 42A-42B); region highlighted has a perfect match between normal repeat and degenerate repeat (other part of degenerate repeat does not match). FIG. 42M-42N-2 shows predicted structures of tracrRNAs base-paired with the repeats. Putative tracrRNAs were identified based on presence of an anti-direct repeat (DR) sequence. Anti-DRs were identified using Geneious (geneious.com) by searching for sequences within each respective CRISPR locus that are highly homologus to DR. The 5' and 3' ends of each putative tracrRNA was determined though computational prediction of bacterial transcription start and termination sites using BPROM (softberry.com) and ARNOLD (u-psud.fr/toolbox/arnold/) respectively. Co-folding predictions were generated using Geneious. 5' ends are colored dark gray and 3' ends are colored gray. FIG. 42C-1-42C-2 discloses SEQ ID NOS 1529-1557, respectively, in order of appearance. FIG. 42D-1-42D-2 discloses SEQ ID NOS 1558-1583, respectively, in order of appearance. FIG. 42E-1-42E-2 discloses SEQ ID NOS 1584-1623, respectively, in order of appearance. FIG. 42F-1-42F-2 discloses SEQ ID NOS 1624-1645, respectively, in order of appearance. FIG. 42G-1-42G-2 discloses SEQ ID NOS 1646-1660, respectively, in order of appearance. FIG. 42H-1-42H-2 discloses SEQ ID NOS 1661-1678, respectively, in order of appearance. FIG. 42I-1-42I-3 discloses SEQ ID NOS 1679-1689, respectively, in order of appearance. FIG. 42J-1-42J-2 discloses SEQ ID NOS 1690-1719, respectively, in order of appearance. FIGS. 42K-1-42L disclose "Normal Repeat" sequences as SEQ ID NOS 1720-1735, "Spacer" sequences as SEQ ID NOS 1736-1751, and "Downstream" sequences as 1752-1767, all respectively, in order of appearance. FIG. 42M discloses SEQ ID NOS 1768-1771, respectively, in order of appearance. FIG. 42N-1-42N-2 discloses SEQ ID NOS 1772-1775, respectively, in order of appearance.

FIG. 43A-43F. FIG. 43A-43B shows the Table presenting the analysis of Type V-C (C2c3 protein-encoding) loci. * CRISPR—CRISPR repeat; unk—hypothetical protein; >—direction of gene coding sequence; [D]—degenerate repeat (defined where it was possible). FIG. 43C-43D-2 shows CRISPR arrays analysis of Type V-C(C2c3 protein-encoding) loci as disclosed herein (CRISPR section is basic output of CRISPRfinder (see for description:u-psud.fr/Server/); repeat folding was done with mfold (see mfold site for description of output: albany.edu/?q=mfold/DNA-Folding-Form); repeat folding and CRISPRS array are placed after detailed description of each case; for CRISPR location see link in the Table in FIG. 43A-43B). Statistically significant spacer's blast hits in prokaryotes or their viruses are shown. FIG. 43E shows CRISPRmap classification of CRISPR repeats of Type V-C(C2c3 protein-encoding) loci as disclosed herein using CRISPRmap (see uni-freiburg.de/CRISPRmap for details). FIG. 43F shows degenerate repeats of Type V-C(C2c3 protein-encoding) loci as disclosed herein found using CRISPRs finder (u-psud.fr/Server/). Normal repeat column contains normal repeat, spacer—the last spacer, downstream—downstream region starting from degenerate repeat (250 bp); array number corresponds to the number of CRISPR array in the respective locus (see the Table in FIG. 43A-43B); region highlighted has a perfect match between normal repeat and degenerate repeat (other part of degenerate repeat does not match). FIG. 43C discloses SEQ ID NOS 1776-1807, respectively, in order of appearance. FIG. 43D-1-43D-2 discloses SEQ ID NOS 1808-1828, respectively, in order of appearance. FIG. 43E discloses SEQ ID NOS 1829-1834, respectively, in order of appearance. FIG. 43F discloses SEQ ID NOS 1835-1837, respectively, in order of appearance.

FIG. 44A-44E-2 provides complete list of CRISPR-Cas loci in the genomes where C2c1 or C2c2 proteins were found. Genes for C2c1 and C2c2 proteins are highlighted. Spacers FIG. 44A-44E-2 disclose SEQ ID NOS 1838-1886, respectively, in order of appearance.

FIGs. 45A-45C shows alignment of *Listeria* loci encoding putative Type VI CRISPR-Cas system. The aligned syntenic region corresponds to *Listeria weihenstephanensis* FSL R9-0317 contig AODJ01000004.1, coordinates 42281-46274 and *Listeria* newyorkensis strain FSL M6-0635 contig JNFB01000012.1, coordinates 169489-173541. Spacers—bold. FIGS. 45A-45C disclose SEQ ID NOS 1887-1888, respectively, in order of appearance.

FIG. 49A-49B shows expression and processing of C2c2 loci. FIG. 49A: RNA-sequencing of the *Listeria seeligeria* serovar 1/2b str. SLCC3954 C2c2 locus expressed in *E. coli*. The locus is highly expressed with a processed crRNA showing a 5' 29-nt DR and 15-18 nt spacer. The putative tracrRNA shows no expression. In silico RNA-folding of the processed crRNA direct repeat shows a strong hairpin. FIG. 49B: Northern blot analysis of the *Leptotrichia shahii* DSM 19757 expressed in *E. coli* shows processed crRNAs with a 5' DR. Arrows indicate the probe positions and their directionality. FIG. 49A discloses SEQ ID NOS 1893-1894, respectively, in order of appearance.

FIG. 50A-50C shows expression and processing of the *Leptotrichia shahii* DSM 19757 C2c2 locus. FIG. 50A: RNA-sequencing of the *Leptotrichia shahii* DSM 19757 locus expressed in *E. coli* shows processing of the CRISPR array in the 3' to 5' direction (direction of the locus). crRNAs are processed to have a 5' DR that is 28 nt in length and spacers with lengths 14-28 nt. FIG. 50B RNA-sequencing of the endogenous *Leptotrichia shahii* DSM 19757 C2c2 locus shows similar results to FIG. 50A. FIG. 50C: In silico folding of the *L. shahii* crRNA DR predicts stable secondary structure. FIG. 50A discloses SEQ ID NO: 1895. FIG. 50B discloses SEQ ID NO: 1896. FIG. 50C discloses SEQ ID NO: 1897.

FIG. 55 Identification of PAM sequence. Depleted sequences identify the 5' PAM nucleotides

FIG. 57 depicts purification of C2c2 by His-Tag purification followed by one round (left) or three rounds (middle) of gel filtration, and a single 168 kD band by coomassie stain (right).

FIG. 63A-63C depicts effect on RFP expression of C2c2 with targeting RNA complementary or non-complementary to expressed RNA. FIG. 63A Schematic of RFP targeting in heterologous *E. coli* system. LshC2c2 loci harboring spacers targeting RFP at various PAMs were introduced into RFP-expressing *E. coli*. FIG. 63B Quantitation of RFP targeting in *E. coli* for multiple spacers targeting A, C, or U PAMs. RFP expression was measured by flow cytometry. FIG. 63C Quantitation of RFP targeting in *E. coli*. Spacers with various PAMs targeting either the non-coding strand ("DNA") or coding strand ("RNA") of the RFP gene were introduced and RFP expression was measured by flow cytometry. FIG. 63A discloses SEQ ID NO: 1899.

FIG. 75A-75J. FIG. 75A-75C shows identification of a single base right PAM for LshC2c2 by RNA PAM screen using MS2 phage interference. More particularly it shows the presence of a right H PAM (not G). FIG. 75C shows the quantitation of MS2 plaque assay validating the presence of the PAM. Multiple spacers targeting each PAM were cloned into the LshC2c2 locus. Phage dilutions were spotted on bacteria plates and interference was quantified by highest dilution without plaques. FIG. 75D shows representative images from validation of MS2 plaque assay showing reduced plaque formation in H PAM spacers, but not in G PAM spacers. FIG. 75E shows nuclease activity with G PAM spacers and resistance with H PAM spacers. FIG. 75 F shows a schematic of the RNA target, showing the protospacer region and the corresponding crRNA. FIG. 75 G shows denaturing gel demonstrating ssRNA cleavage activity of LshC2c2 using an RNA target that is 5' labeled with IRDye 800 and 3' labeled with Cy5. Four independent cleavage sites are observed. FIG. 75 H shows a denaturing gel demonstrating the H PAM (not G). ssRNA cleavage activity is dependent on the nucleotide immediately 3' of the target site. The PAM was tested by mutating this adjacent nucleotide and using the same crRNA/target site. FIG. 75 I is a schematic showing the positions of tiled crRNAs to demonstrate retargeting of LshC2c2 and the H PAM (top panel) and the corresponding denaturing gel (bottom panel). Five different crRNAs were tested for each possible nucleotide. Also shown is a denaturing gel demonstrating the H PAM using different crRNAs tiled along the length of the ssRNA target. Five different crRNAs were tested for each possible nucleotide. FIG. 75J shows a denaturing gel testing the presence of a spacer motif. Three crRNAs with every possible last nucleotide as the last base of the spacer sequence were tested. FIG. 75D discloses SEQ ID NOS 1901-1904, respectively, in order of appearance. FIG. 75F discloses SEQ ID NOS 1905-1906, respectively, in order of appearance. FIG. 75I discloses SEQ ID NOS 1907-1910, respectively, in order of appearance.

FIG. 78A-78B demonstrates that LshC2c2 efficiently cleaves RNA. Mini gel readout; non fluorescence. FIG. 78C demonstrates ssRNA cleavage by LshC2c2 using a 5' labeled and 3' labeled target were assayed at the indicated time points. FIG. 78D shows the quantitation of data of FIG. 78B.

FIG. 82 shows RNA-sequencing of in vitro nuclease reaction

FIG. 90A and 90B demonstrate ssRNA cleavage was assayed using crRNAs of varied spacer length. FIG. 90B discloses SEQ ID NOS 1911-1914, respectively, in order of appearance.

FIG. 91A, 91B, and 91C demonstrates ssRNA cleavage was assayed using crRNAs of varied DR length. RNA cleavage is crRNA length dependent (FIG. 91A, 91B). RNA cleavage is DR length dependent FIG. 91C-91E). FIG. 91A discloses SEQ ID NO: 1915. FIG. 91B discloses SEQ ID NO: 1916. FIG. 91C discloses SEQ ID NO: 1917.

FIG. 92A-92D. FIG. 92A, 92B, 92C, and 92D show LshC2c2 cr Stem Modifications and demonstrates that Stem is amenable to individual base swaps but activity is disrupted by most secondary structure changes. DR Truncation experiments also indicate that disruption of the stem abolishes cleavage. FIG. 92A discloses SEQ ID NOS 1918-1927, respectively, in order of appearance. FIG. 92D discloses SEQ ID NOS 1928, 2231, 1930-1934, 2232 and 1936-1937, top to bottom, left to right, respectively, in order of appearance.

FIG. 93A, 93B, 93C, and 93D shows LshC2c2 cr loop Modifications and demonstrates that the crRNA loop is amenable to base changes and extension but not truncation. FIG. 93A discloses SEQ ID NOS 1938-1947, respectively, in order of appearance. FIG. 93D discloses SEQ ID NOS 1948-1956, respectively, in order of appearance.

FIG. 97A-97D. FIG. 97 A schematic shows different HEPN mutations in C2c2. Schematic of locus and LshC2c2 protein, showing conserved residues in HEPN domains. FIGS. 97 B and 97C demonstrate that each of the HEPN mutants significantly lack activity. 97C top panel: Denaturing gel showing conserved residues of the HEPN motif are necessary for ssRNA cleavage. 97C bottom panel: Quantitation of MS2 plaque assay with HEPN catalytic residue mutants. Loci with mutant LshC2c2 were unable to protect against phage. FIG. 97D. Quantitation of RFP targeting in *E. coli* with arginine HEPN catalytic residue mutants. Loci with mutant LshC2c2 were unable to knock down RFP. FIG. 97C discloses SEQ ID NOS 1957-1958, respectively, in order of appearance. FIG. 97D discloses SEQ ID NO: 1959.

FIG. 99A demonstrates that the C2c2 HEPN mutant still binds the crRNA. FIGS. 99B and 99C demonstrate the influence of secondary structure of the RNA on cleavage product of the target RNA. FIG. 99B discloses SEQ ID NOS 2225-2228, respectively, in order of appearance.

FIG. 100A shows the effect of different divalent cations on C2c2 activity. FIG. 100B shows the effect of crRNA titration in the presence or absence of magnesium.

FIG. 103 demonstrates that C2c2 cuts 3' of target site. Figure discloses SEQ ID NO: 1960.

FIG. 104 shows C2c2 reprogramming with crRNAs. Figure discloses SEQ ID NO: 1961.

FIG. 109-1-109-2 illustrates the sequences alignment of the following orthologs of the *Leptotrichia shahii* DSM 19757 C2c2: *Rhodobacter capsulatus* SB 1003 (RcS); *Rhodobacter capsulatus* R121 (RcR); *Rhodobacter capsulatus* DE442 (RcD); *Lachnospiraceae bacterium* MA2020 (Lb (X)); *Lachnospiraceae bacterium* NK4A179 (Lb(X); [*Clostridium*] *aminophilum* DSM 10710 (CaC); *Lachnospiraceae bacterium* NK4A144 (Lb(X); *Leptotrichia wadei* F0279 (Lew); *Leptotrichia wadei* F0279 (Lew); *Carnobacterium gallinarum* DSM 4847 (Cg); *Carnobacterium gallinarum* DSM 4847 (Cg); *Paludibacter propionicigenes* WB4 (Pp); *Listeria seeligeri* serovar 1/2b (Ls); *Listeria weihenstephanensis* FSL R9-0317 (Liw); and *Listeria bacterium* FSL M6-0635 (Lib).

FIG. 110 depicts conserved HEPN domains of C2c2 proteins. Figure discloses SEQ ID NOS 1962-2057, respectively, in order of appearance.

FIG. 112A-112D. Effect of RNA target-crRNA mismatches on LshC2c2 RNAse activity. FIG. 112A. Quantitation of MS2 plaque assay testing single mismatches at various positions in the spacer. Single mismatches have minimal effect on phage interference. Locations of mismatches are shown in italics; all mismatches are transversions. FIG. 112B. Quantitation of MS2 plaque assay testing double mismatches at various positions in the spacer. Consecutive double mismatches in the middle of the spacer eliminate phage interference. Locations of mismatches are shown in italics; all mismatches are transversions. FIG. 112C. in vitro Lshc2c2 cleavage assaying single mismatches in the crRNA. Single mismatches have minimal effect on ssRNA cleavage. Locations of mismatches are shown in italics; all mismatches are transversions.

FIG. 112D. in vitro Lshc2c2 cleavage assaying double mismatches in the crRNA. Consecutive double mismatches in the middle of the crRNA abrogate LshC2c2 activity. Locations of mismatches are shown in italics; all mismatches are transversions. FIG. 112A discloses SEQ ID NO: 2058. FIG. 112B discloses SEQ ID NO: 2059. FIG. 112C discloses SEQ ID NO: 2060. FIG. 112D discloses SEQ ID NO: 2061.

FIG. 113-1-113-3 Cleavage of three ssRNA targets that have the same crRNA target sequence flanked by different sequences. The secondary structure and sequence of each of the three targets is shown (top) and the cleavage patterns of each target by C2c2 are shown using a 10% PAGE gel (bottom). Figure discloses SEQ ID NOS 2062-2067, respectively, in order of appearance.

FIG. 114A-114B-2. Mapping of C2c2 cleavage sites by RNA sequencing 114A by position; 114B-1-114B-2 by secondary structure. A Plots of the frequency of cleavage ends observed in RNA-sequencing data for 5' anchored fragments. This data is projected onto secondary structure in (114B-1-114B-2). FIG. 114B-1-114B-2. The cleavage sites of targets 1 and 3 were mapped using RNA-sequencing of the cleavage reaction. The frequency of ends of each fragment (anchored at the 5' end) are mapped to z-scores and projected onto the secondary structure of the target. FIG. 114B-1-114B-2 discloses SEQ ID NOS 2068-2071, respectively, in order of appearance.

FIG. 116A-116E. Heterologous expression of the *Leptotrichia shahii* C2c2 locus mediates robust interference of RNA phage in *Escherichia coli*. FIG. 116A Schematic for the MS2 bacteriophage interference screen. A library consisting of spacers targeting all possible sequences in the MS2 RNA genome was cloned into the LshC2c2 CRISPR array. Cells transformed with the MS2-targeting spacer library were then treated with phage and plated, and surviving cells were harvested. The frequency of spacers was compared to an untreated control (no phage), and enriched spacers from the phage-treated condition were used for the generation of PAM sequence logos. FIG. 116B Box plot showing the distribution of normalized crRNA frequencies for the phage-treated condition and control screen biological replicates (n=2). The box extends from the first to third quartile with whiskers denoting the 1st and 99th percentiles. The mean is indicated by the horizontal bar. FIG. 116C Sequence logo generated from sequences flanking the 3' end of protospacers corresponding to enriched spacers, revealing the presence of a 3' H PAM (not G). FIG. 116D Plaque assay used to validate the functional significance of the H PAM in MS2 interference. All protospacers flanked by non-G PAMs exhibited robust phage interference. Spacer were designed to target the MS2 mat gene and their sequences are shown above the plaque images; the spacer used in the non-targeting control is not complementary to any sequence in either the *E. coli* or MS2 genome. Phage spots were applied as series of half-log dilutions. FIG. 116E Quantitation of MS2 plaque assay validating the H (non-G) PAM requirement. 4 MS2-targeting spacers were designed for each PAM. Phage dilutions were spotted onto bacterial plates as series of half-log dilutions and interference was estimated based on the highest dilution without plaques. Each point on the scatter plot represents the average of three biological replicates and corresponds to a single spacer. Bars indicate the mean of 4 spacers for each PAM and errors are shown as the s.e.m. FIG. 116A discloses SEQ ID NOS 2072-2076, respectively, in order of appearance. FIG. 116D discloses SEQ ID NOS 2077-2080, respectively, in order of appearance.

FIG. 117A-117D. LshC2c2 and crRNA mediate RNA-guided ssRNA cleavage. FIG. 117A Schematic of the ssRNA substrate being targeted by the crRNA. The protospacer region is highlighted and the PAM is indicated by the bar. FIG. 117B A denaturing gel demonstrating crRNA-mediated ssRNA cleavage by LshC2c2. The ssRNA target is either 5' labeled with IRDye 800 or 3' labeled with Cy5. Cleavage requires the presence of the crRNA and is abolished by addition of EDTA. Four cleavage sites are observed. FIG. 117C A denaturing gel demonstrating the requirement for an H PAM (not G). Four ssRNA substrates that are identical except for the PAM base (indicated by the X in the schematic) were used for the in vitro cleavage reactions. ssRNA cleavage activity is dependent on the nucleotide immediately 3' of the target site. FIG. 117D Schematic showing five protospacers for each PAM on the ssRNA target (top). Denaturing gel showing crRNA-guided ssRNA cleavage activity. crRNAs correspond to protospacer numbering. FIG. 117A discloses SEQ ID NOS 2081-2082, respectively, in order of appearance. FIG. 117D discloses SEQ ID NO: 2083.

Figure 118E:
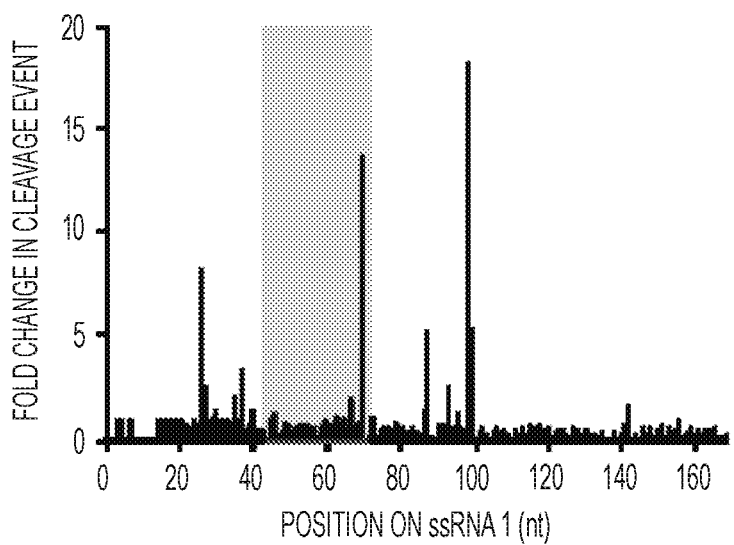
Figure 118G:
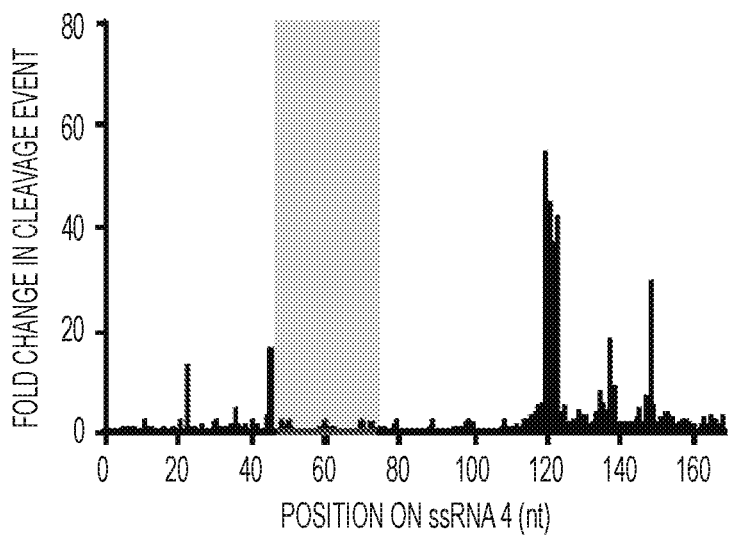
Figure 118I:
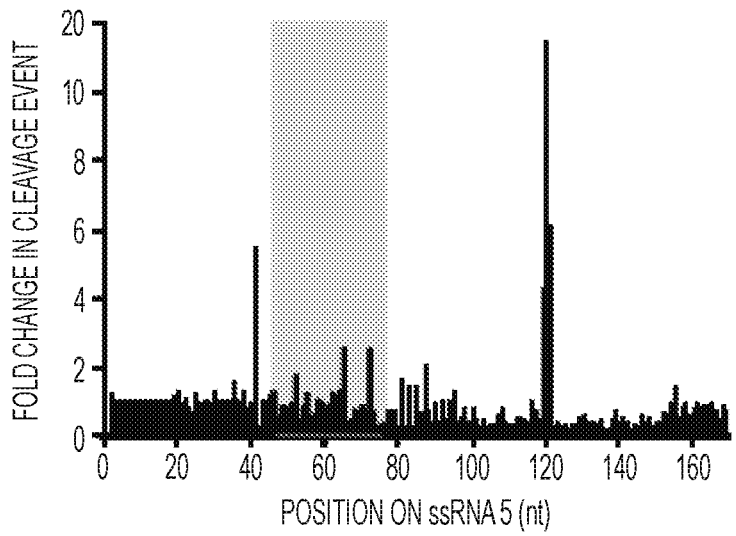
Figure 118D:
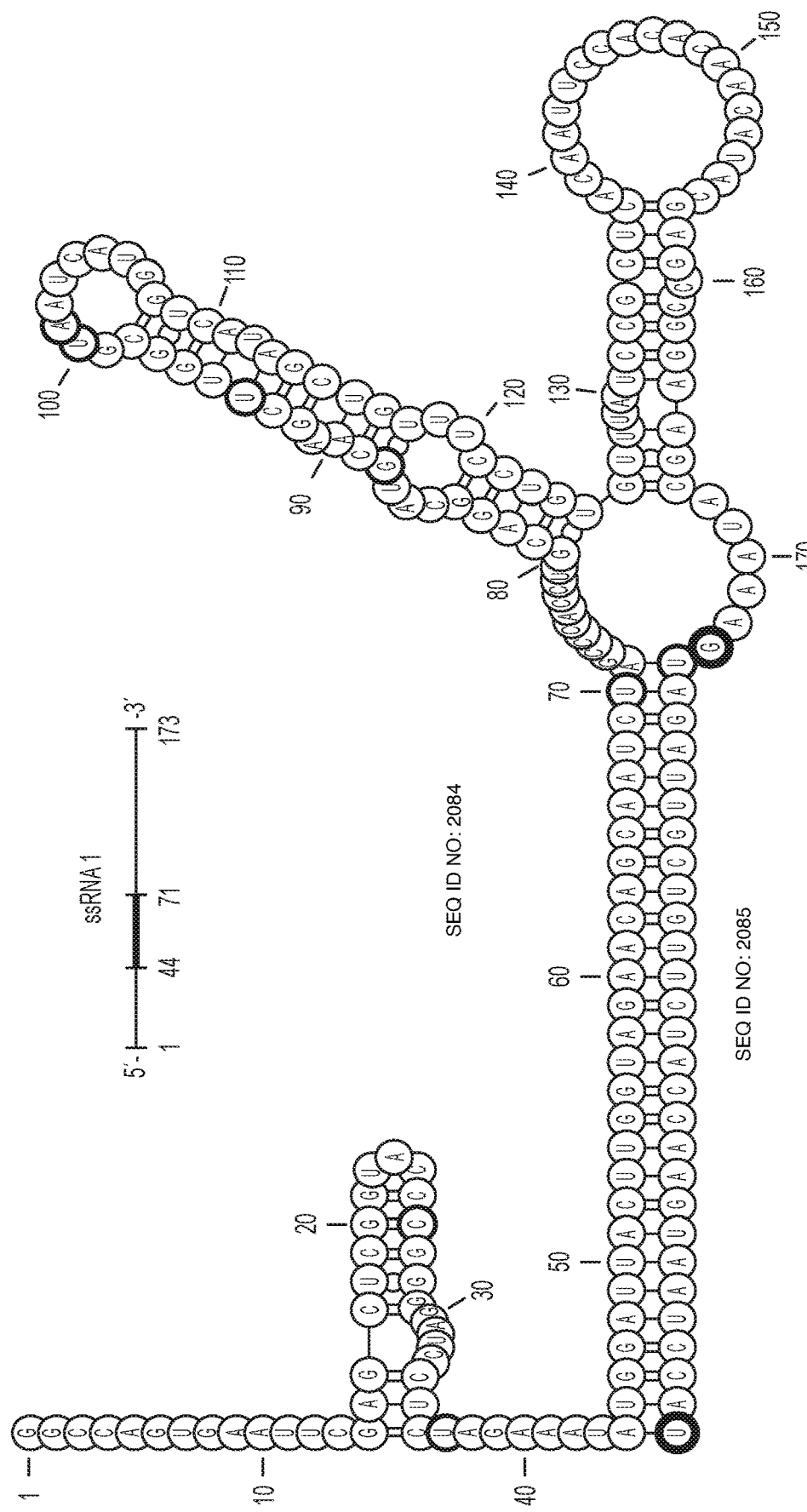
Figure 118F:
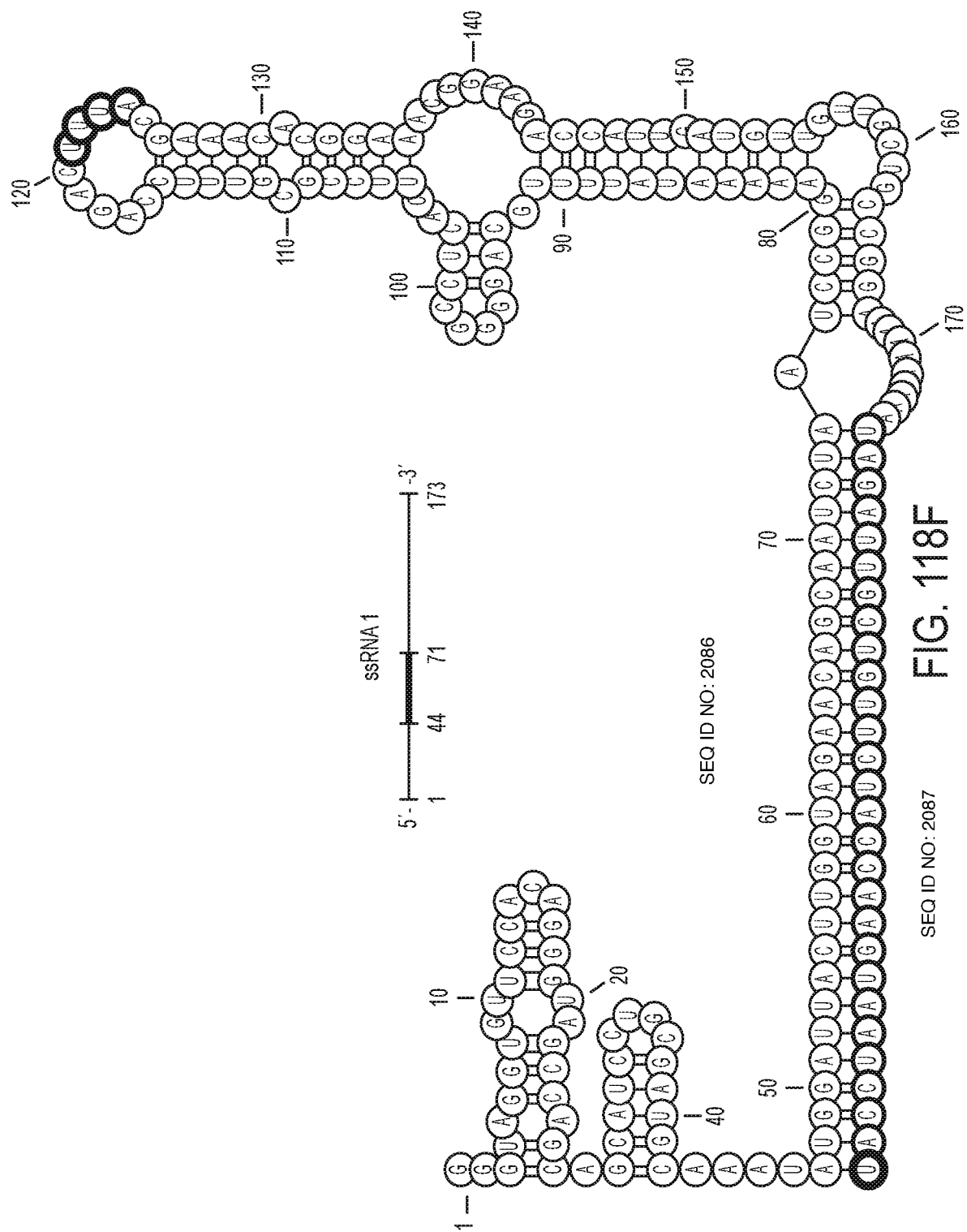
Figure 118H:
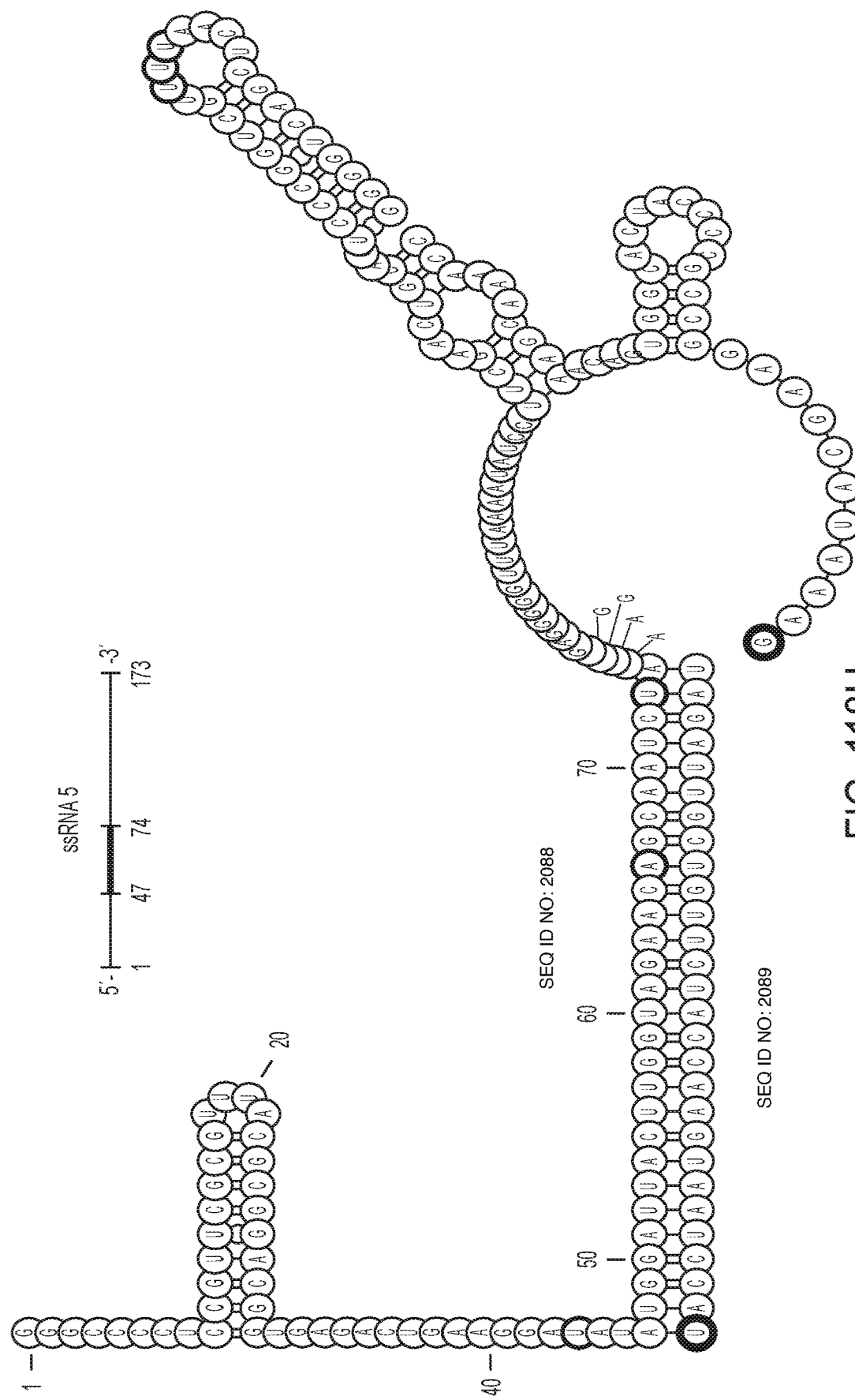

FIG. 118A-118I. C2c2 cleavage sites are determined by secondary structure and sequence of the target RNA. FIG. 118A Schematic of homopolymer ssRNA targets. The protospacer is indicated by the bar. Homopolymer stretches of A and U bases are interspaced by individual bases of G and C. FIG. 118B Denaturing gel showing C2c2-crRNA-mediated cleavage patterns of each homopolymer. FIG. 118C Denaturing gel showing C2c2-crRNA-mediated cleavage of three non-homopolymeric ssRNA targets (1, 4, 5) that share the same protospacer but are flanked by different sequences. Despite identical protospacers, different flanking sequences resulted in different cleavage patterns. (FIGS. 118D, 118F, and 118H) The cleavage sites of non-homopolymer ssRNA targets 1 FIG. 118D, 4 FIG. 118F, and 5 FIG. 118H were mapped using RNA-sequencing of the cleavage products. The frequency of cleavage at each base is colored according to the z-score and shown on the predicted crRNA-ssRNA co-fold secondary structure. Fragments used to generate the frequency analysis contained the complete 5' end. The 5' and 3' end of the ssRNA target are indicated by outlines. The 5' and 3' end of the spacer (outlined) is indicated by highlights. (118E, 118G, and 118I) Plots of the frequencies of cleavage sites for each position of ssRNA targets 1, 4, and 5 for all reads that begin at the 5' end. The protospacer is indicated by the highlighted region. FIG. 118D discloses SEQ ID NOS 2084-2085, respectively, in order of appearance. FIG. 118F discloses SEQ ID NOS 2086-2087, respectively, in order of appearance. FIG. 118H discloses SEQ ID NOS 2088-2089, respectively, in order of appearance.

Figure 119D:
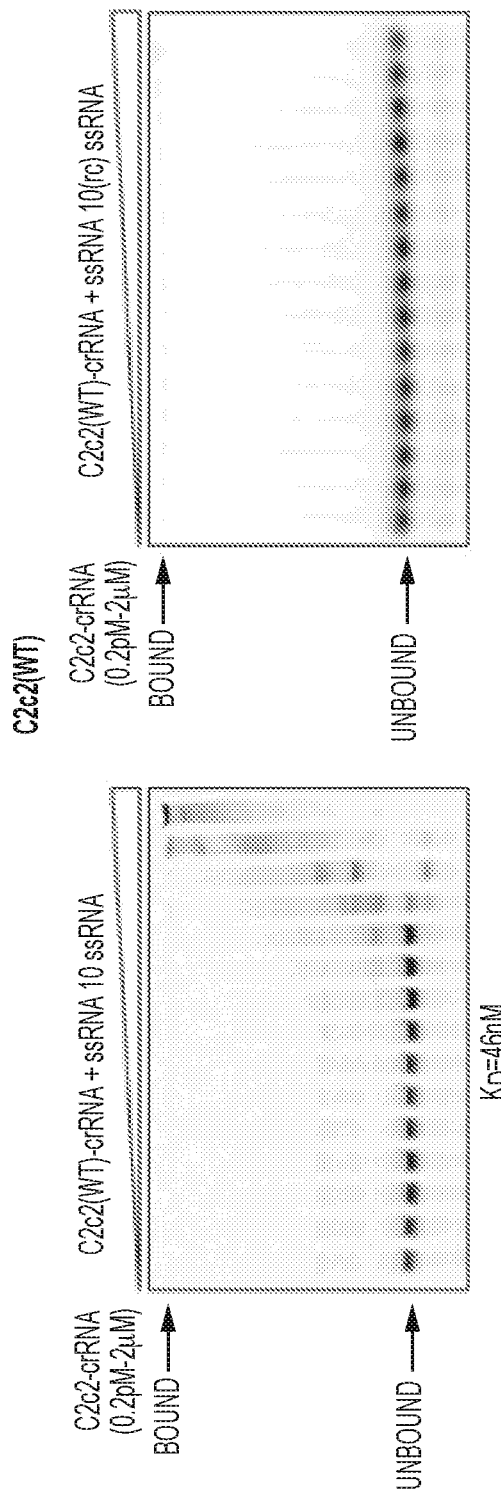
Figure 119E:
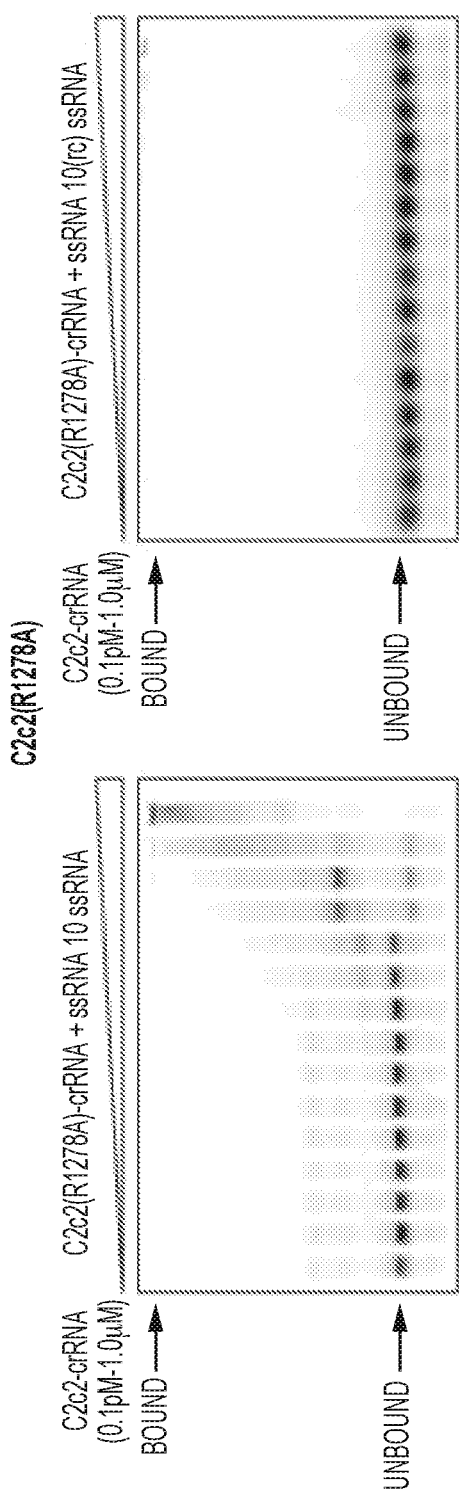

FIG. 119A-119E. The two HEPN domains of C2c2 are necessary for crRNA-guided ssRNA cleavage but not for crRNA-guided ssRNA-binding. FIG. 119A Schematic of the LshC2c2 locus and the domain organization of the LshC2c2 protein, showing conserved residues in HEPN domains. FIG. 119B Quantification of MS2 plaque assay with HEPN catalytic residue mutants. For each mutant, the same crRNA targeting protospacer 35 was used. FIG. 119C Denaturing gel showing conserved residues of the HEPN motif are necessary for crRNA-guided ssRNA cleavage. FIG. 119D Electrophoretic mobility shift assay (EMSA) evaluating affinity of the wild type LshC2c2-crRNA complex against a targeted (left) and a non-targeted (right) ssRNA substrate. The non-targeted ssRNA substrate is the reverse-complement of the targeted ssRNA. EDTA is supplemented to reaction condition to reduce any cleavage activity. FIG. 119E Electrophoretic mobility shift assay with LshC2c2 (R1278A)-crRNA complex against on-target ssRNA and non-targeting complementary ssRNA (same substrate sequences as in 119D). FIG. 119B discloses SEQ ID NOS 2090-2091, respectively, in order of appearance.

FIG. 120A-120B. RNA-guided RNase activity of LshC2c2 is dependent on spacer and direct repeat lengths. FIG. 120A Denaturing gel showing crRNA-guided cleavage of ssRNA 1 as a function of spacer length. FIG. 120B Denaturing gel showing crRNA-guided cleavage of ssRNA 1 as a function of the direct repeat length. FIG. 120A discloses SEQ ID NOS 2092-2095, respectively, in order of appearance. FIG. 120B discloses SEQ ID NO: 2096.

Figure 121A:
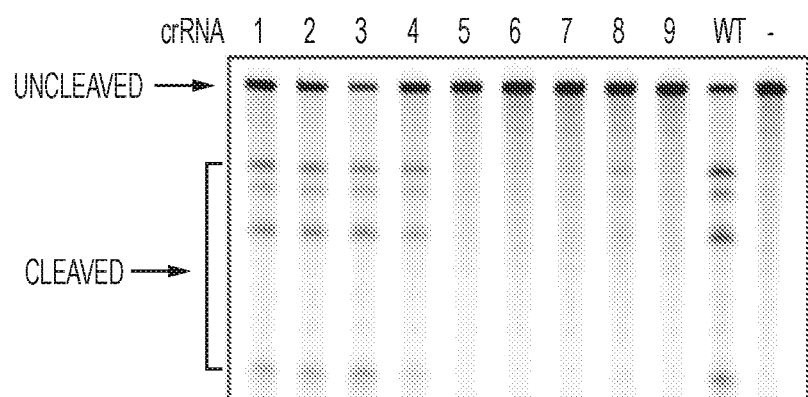
Figure 121B:
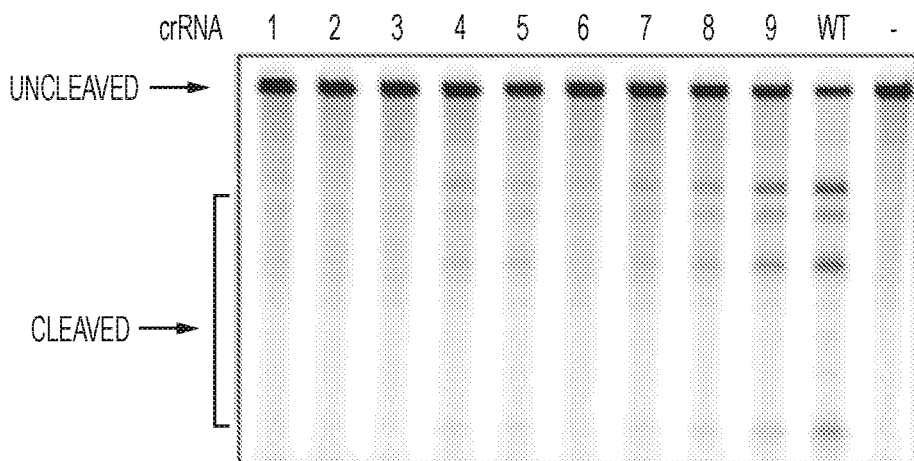

FIG. 121A-121B. RNA-guided RNase activity of LshC2c2 is dependent on direct repeat structure and sequence. FIG. 121A Schematic showing modifications to the crRNA direct repeat stem (top). Altered bases are shown in red. Denaturing gel showing crRNA-guided cleavage of ssRNA 1 by each modified crRNA (bottom). FIG. 121B Schematic showing modifications to the loop region of the crRNA direct repeat (top). Altered bases are shown in gray and deletion lengths are indicated by arrows. Denaturing gel showing crRNA-guided cleavage of ssRNA 1 by each modified crRNA (bottom). FIG. 121A discloses SEQ ID NOS 2097-2106, top to bottom, left to right, respectively, in order of appearance. FIG. 121B discloses SEQ ID NOS 2107-2115, respectively, in order of appearance.

Figures 122A, 122B:
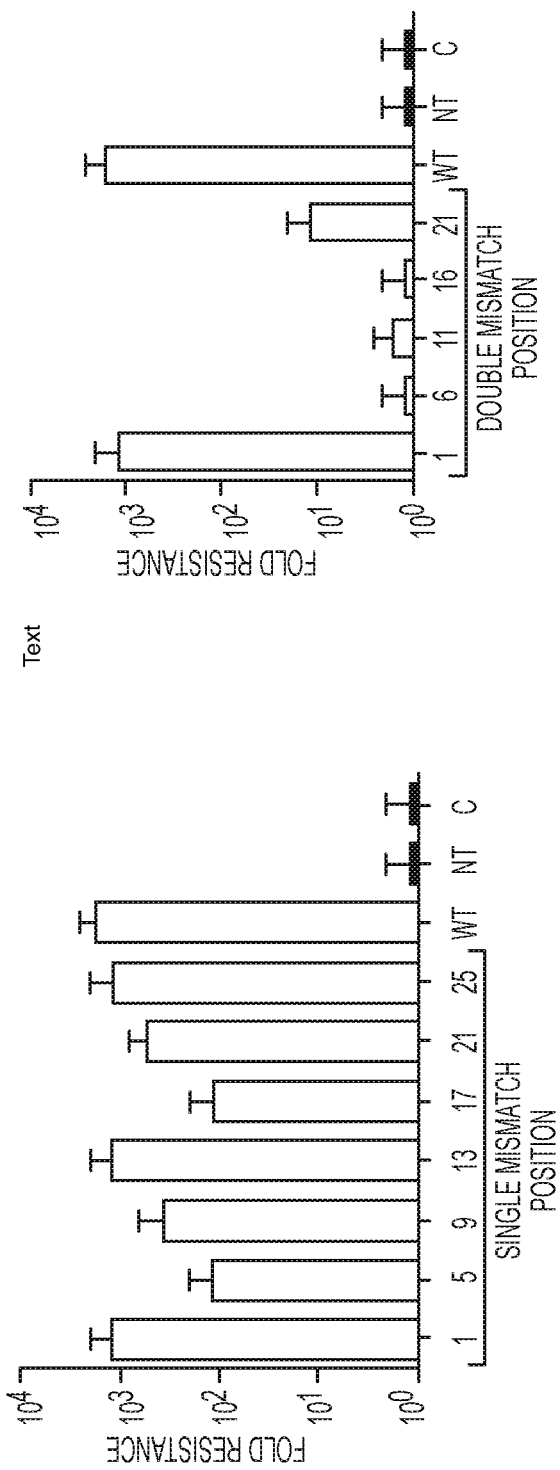
Figures 122C, 122D:
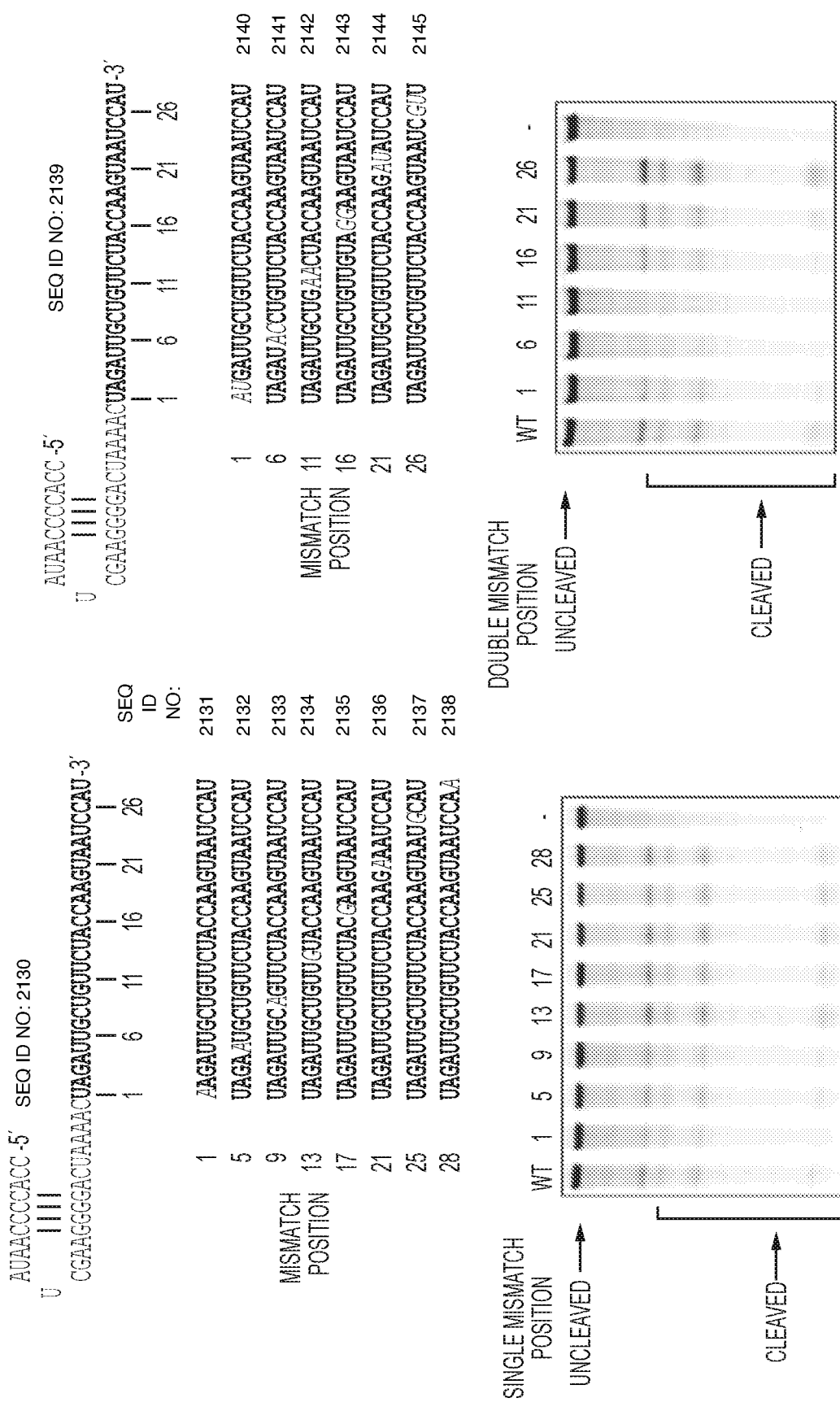

FIG. 122A-122D. Effect of RNA target-crRNA mismatches on LshC2c2 RNase activity. FIG. 122A Quantification of MS2 plaque assays testing single mismatches at various positions in the spacer. Single mismatches have minimal effect on phage interference. Locations and identity of mismatches are shown in italics. FIG. 122B Quantification of MS2 plaque assays testing double mismatches at various positions in the spacer. Consecutive double mismatches in the middle of the spacer eliminate phage interference. Locations and identity of mismatches are shown in italics. FIG. 122C Schematic showing the position and identity of mismatches in the crRNA spacer (top). Denaturing gel showing cleavage of ssRNA 1 guided by crRNAs with single mismatches in the spacer (bottom). FIG. 122D Schematic showing the position and identity of pairs of mismatches (italics) in the crRNA spacer (top). Denaturing gel showing cleavage of ssRNA 1 guided by crRNAs with pairs of mismatches in the spacer (bottom). FIG. 122A discloses SEQ ID NOS 2116-2123, respectively, in order of appearance. FIG. 122B discloses SEQ ID NOS 2124-2129, respectively, in order of appearance. FIG. 122C discloses SEQ ID NOS 2130-2138, respectively, in order of appearance. FIG. 122D discloses SEQ ID NOS 2139-2145, respectively, in order of appearance.

Figure 123A:
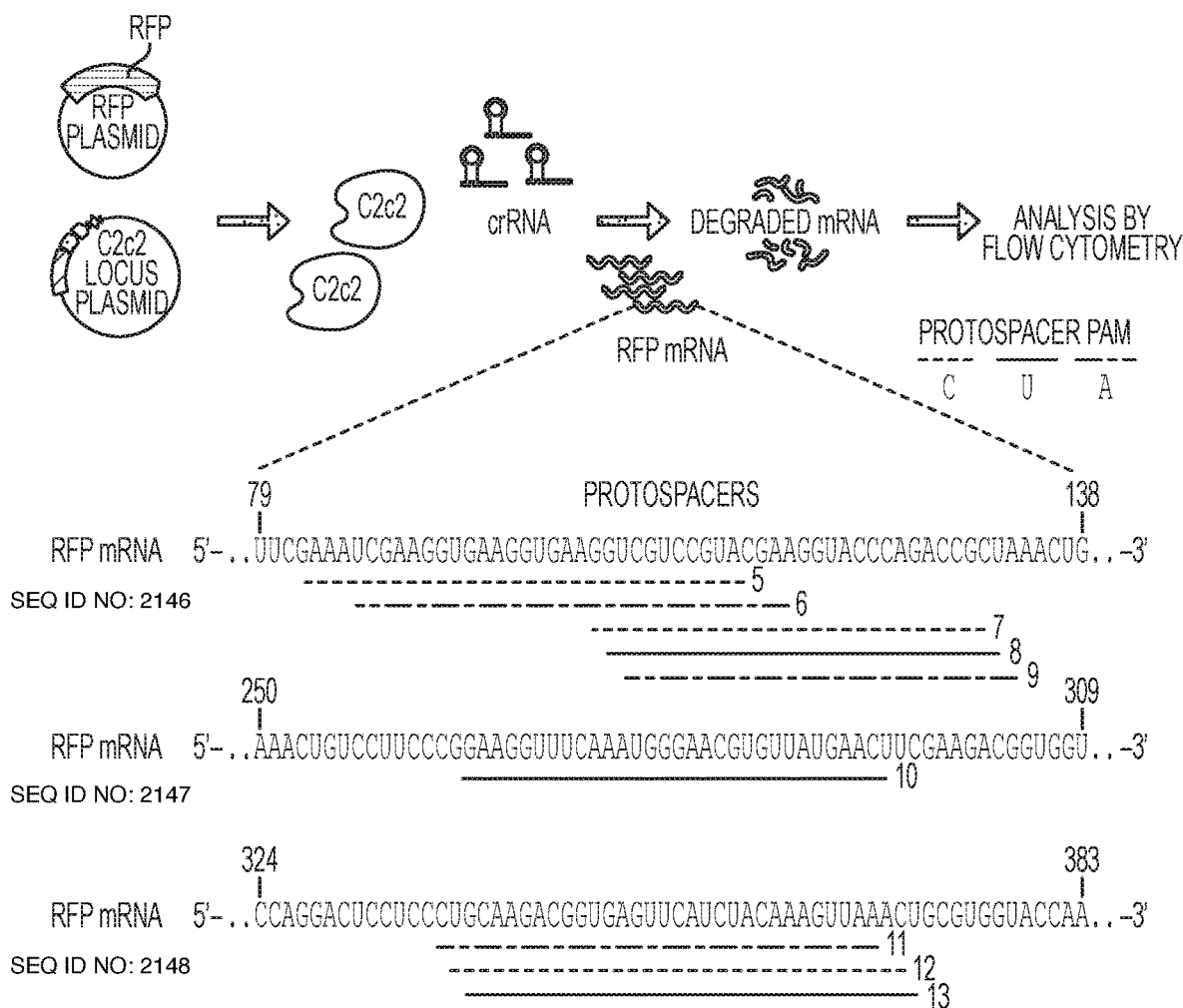
Figure 123B:
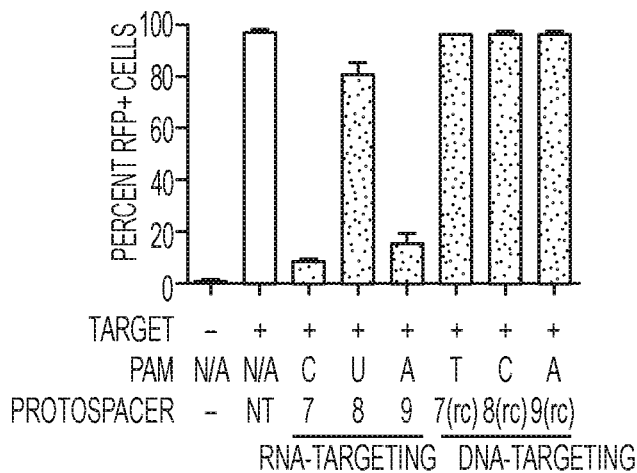
Figure 123C:
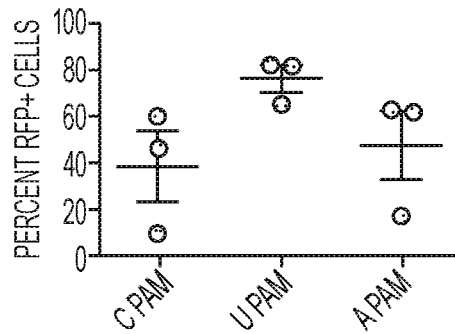
Figure 123D:
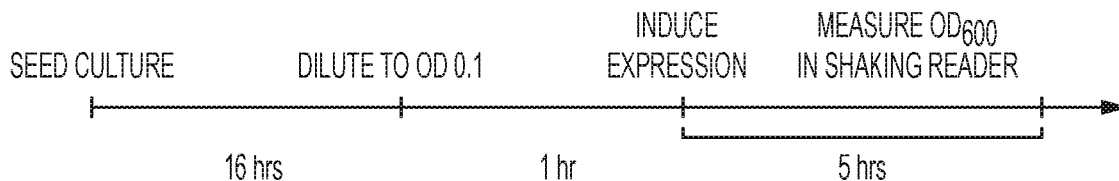
Figure 123E:
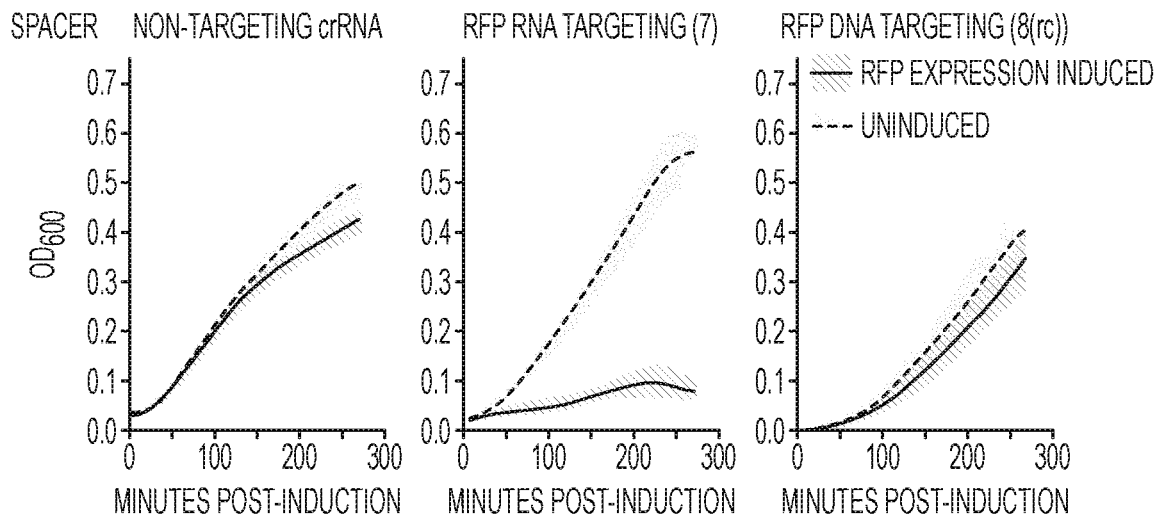

FIG. 123A-123E. RFP mRNA knockdown by retargeting LshC2c2. FIG. 123A Schematic showing crRNA-guided knockdown of RFP in *E. coli* heterologously expressing the LshC2c2 locus. Three RFP-targeting spacers were selected for each non-G PAM and each protospacer on the RFP mRNA is numbered. FIG. 123B RFP mRNA-targeting spacers effected RFP knockdown whereas DNA-targeting spacers (coding strand of the RFP gene on the expression plasmid, indicated as "rc" spacers) did not affect RFP expression. n=3 biological replicates. FIG. 123C Quantification of RFP knockdown in *E. coli*. Three spacers each targeting C, U, or A PAM-flanking protospacers (9 spacers, numbered 5-13 as indicated in panel (123A)) in the RFP mRNA were introduced and RFP expression was measured by flow cytometry. Each point on the scatter plot represents the average of three biological replicates and corresponds to a single spacer. Bars indicate the mean of 4 spacers for each PAM and errors are shown as the s.e.m. FIG. 123D Timeline of *E. coli* growth assay. FIG. 123E Effect of RFP mRNA targeting on the growth rate of *E. coli* transformed with an inducible RFP expression plasmid as well as the LshC2c2 locus with non-targeting, RNA targeting (spacer complementary to RFP gene non-coding strand), and DNA targeting (spacer complementary to RFP gene coding strand) spacers. FIG. 123A discloses SEQ ID NOS 2146-2148, respectively, in order of appearance.

Figures 124A, 124B:
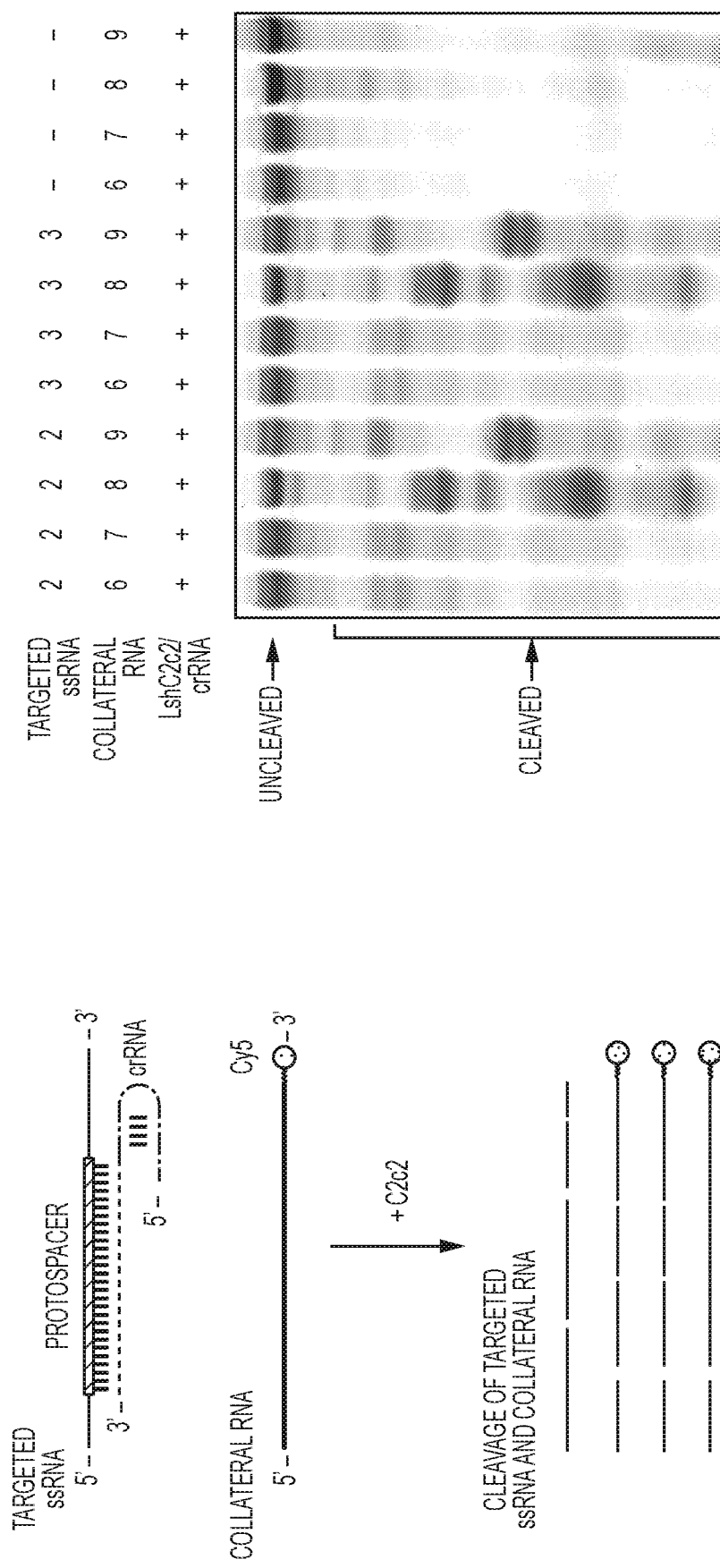

FIG. 124A-124B. crRNA-guided target ssRNA cleavage activates non-specific RNase activity of LshC2c2. FIG. 124A Schematic of the biochemical assay for assaying non-specific RNase activity on non-crRNA-targeted collateral RNA molecules. In addition to the unlabeled crRNA-targeted ssRNA substrate, a second ssRNA with 3' fluorescent labeling is added to the same reaction to readout non-specific RNase activity. FIG. 124B Denaturing gel showing non-specific RNase activity against non-targeted ssRNA substrates in the presence of target RNA. The non-targeted ssRNA substrate is not cleaved in the absence of the crRNA-targeted ssRNA substate.

Figure 125:
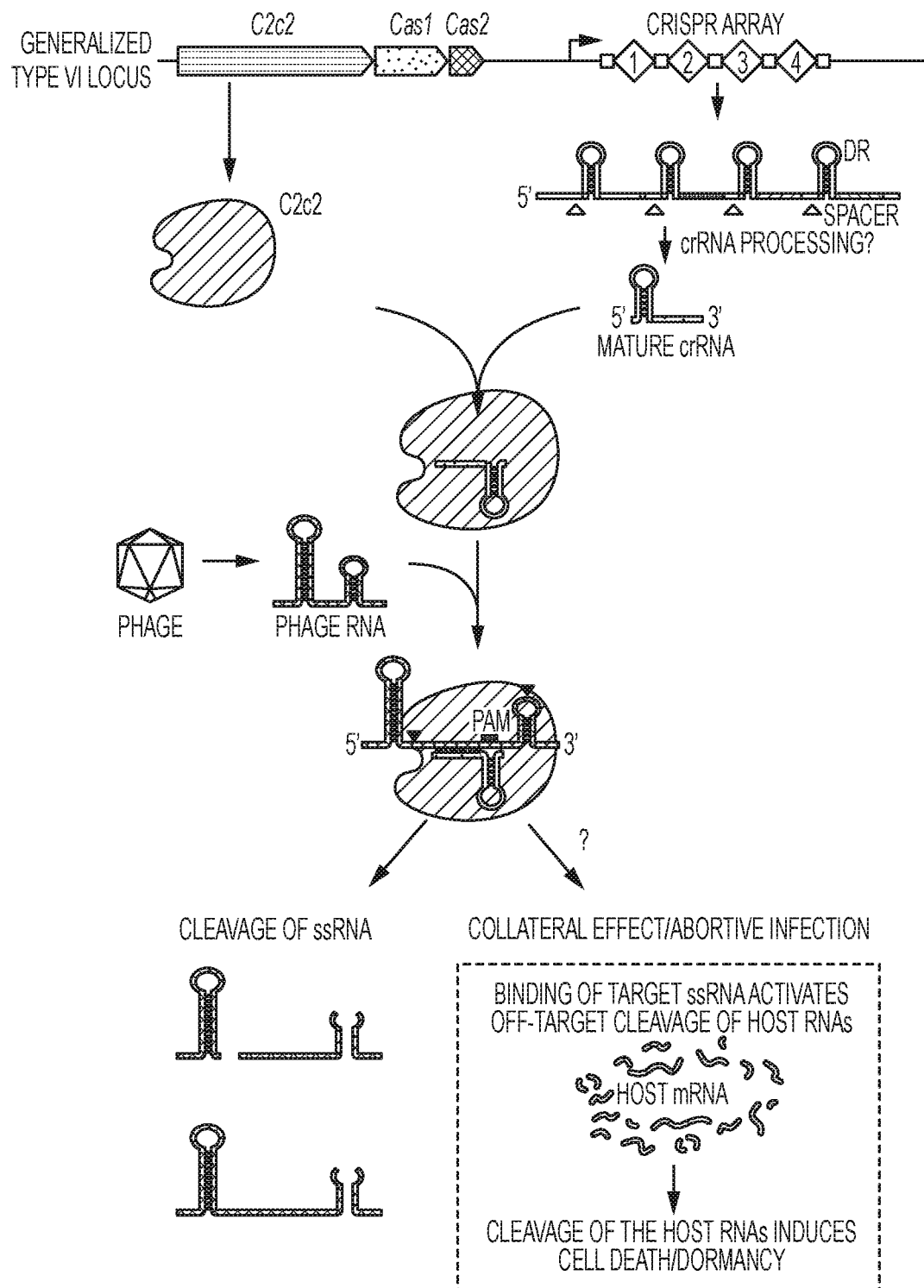

FIG. 125. C2c2 is an RNA adaptive immune system with possible involvement in abortive infection via programmed cell death or dormancy induction.

FIG. 126. RNA-sequencing of the *Leptotrichia shahii* locus heterologously expressed in *E. coli* and spacer analysis. Adapted from S. Shmakov et al., Discovery and Functional Characterization of Diverse Class 2 CRISPR-Cas Systems. Mol Cell 60, 385-397 (2015). Heterologous expression of the LshC2c2 locus reveals processing of the array. Insert: In silico co-folding analysis of a mature direct repeat. Figure discloses SEQ ID NOS 2149-2150, respectively, in order of appearance.

Figure 127A:
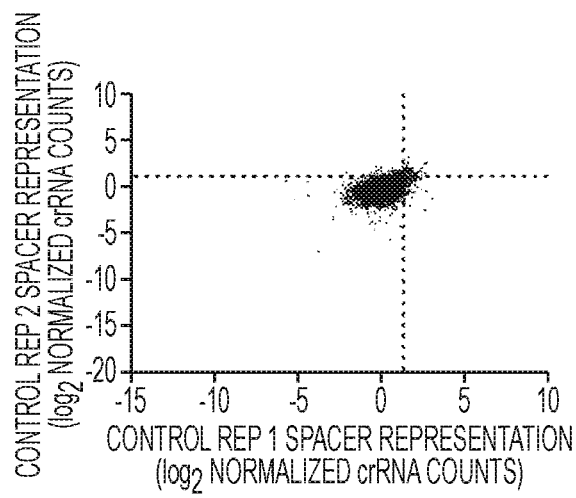
Figure 127B:
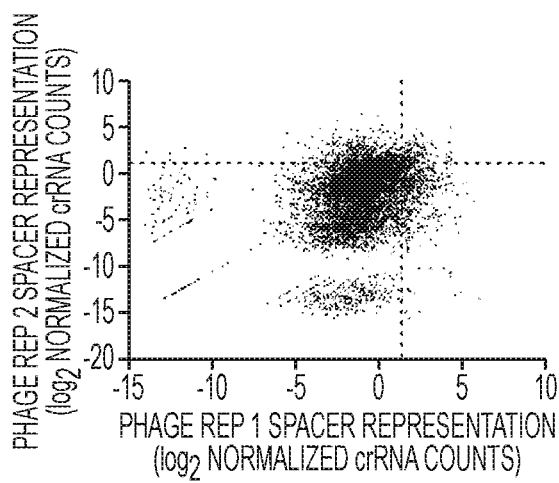
Figure 127C:
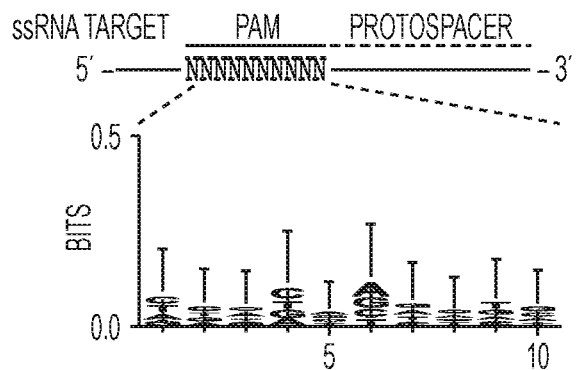
Figure 127D:
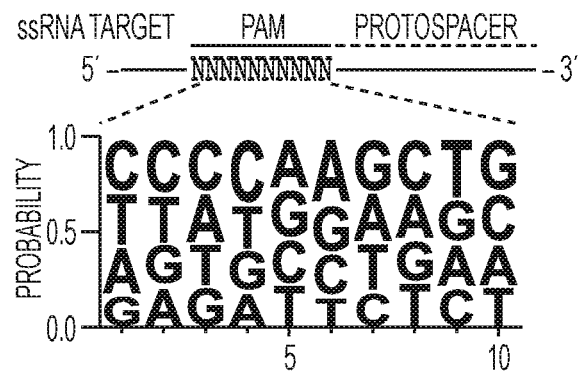

FIG. 127A-127D. MS2 phage screen replicates show agreement and do not have a 5' PAM. FIG. 127A Comparison of control (no phage) replicates show agreement and lack of enrichment or depletion. FIG. 127B Comparison of phage replicates reveals both substantial depletion as well as an enriched population shared between both replicates. FIG. 127C Sequence logo of 5' sequence from enriched spacers admits no PAM. FIG. 127D Base frequency of 5' sequence from enriched spacers admits no 5' PAM.

Figure 128A:
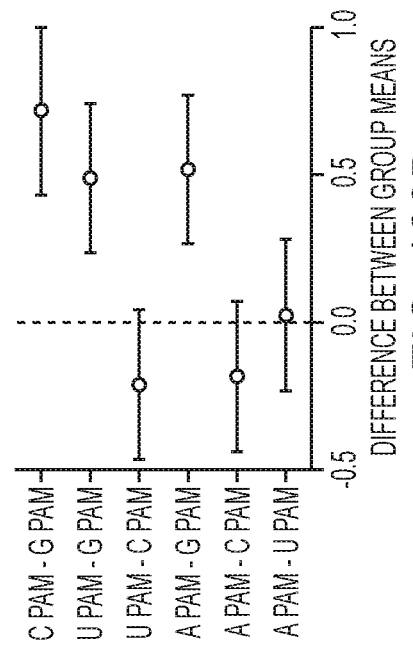
Figure 128B:
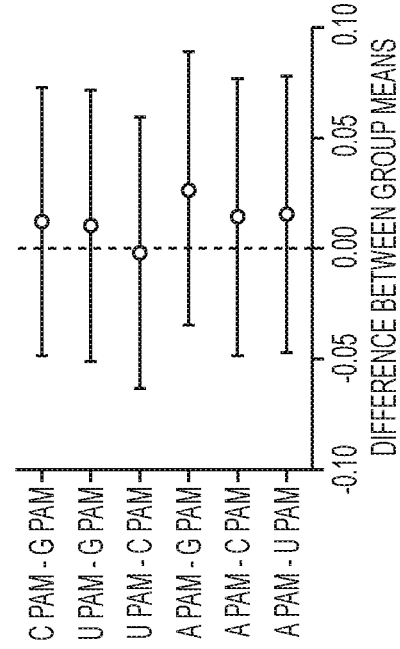
Figure 128C:
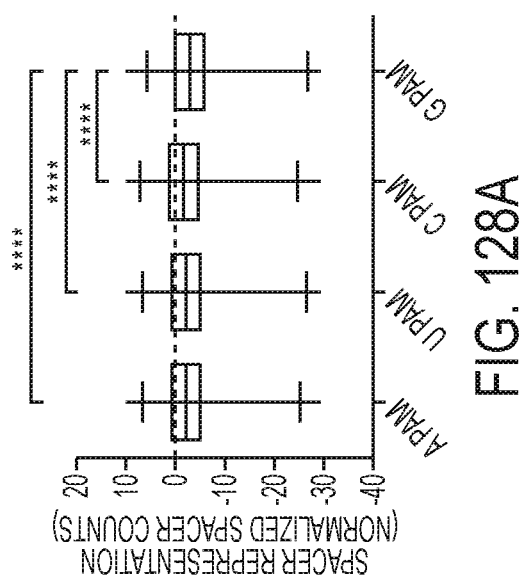
Figure 128D:
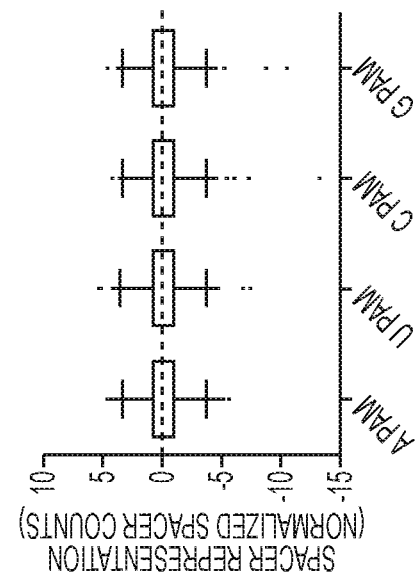
Figure 128E:
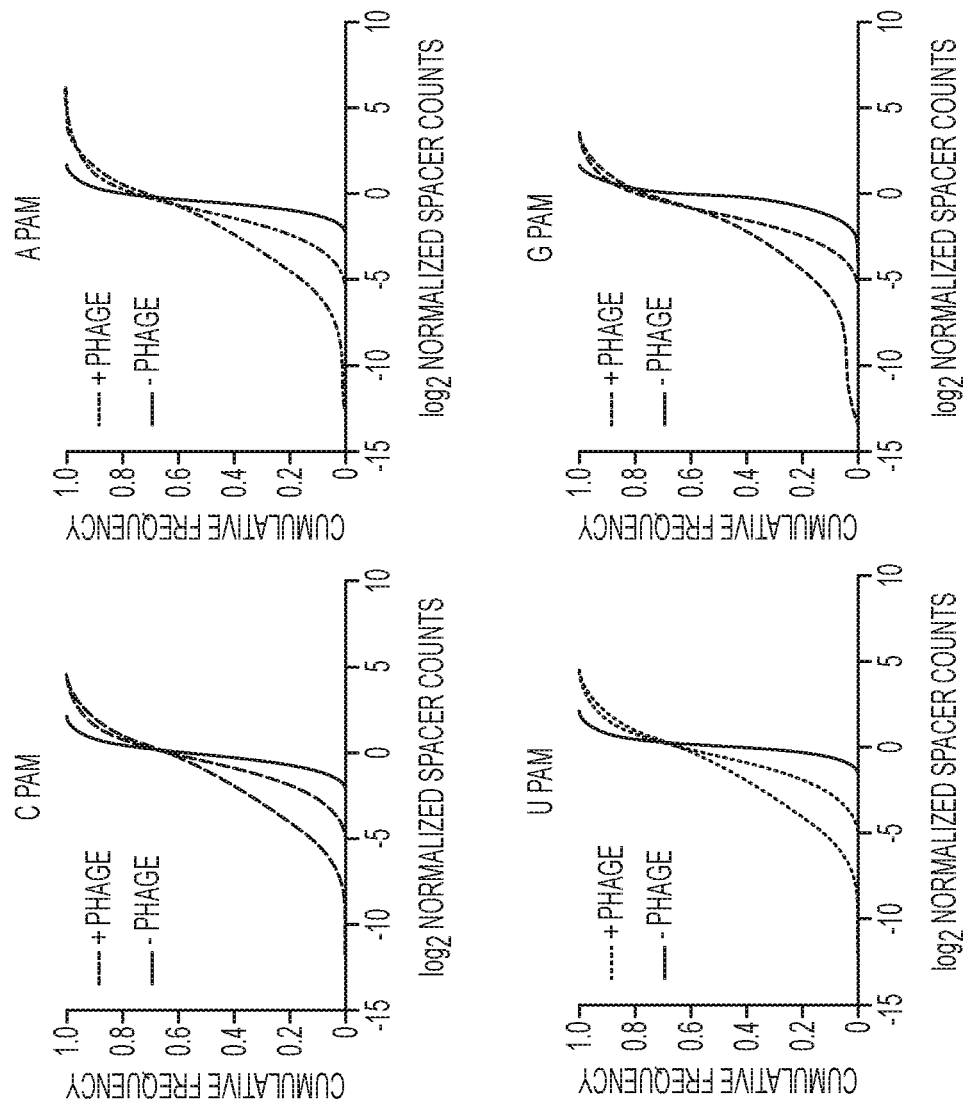
Figures 128F, 128G:
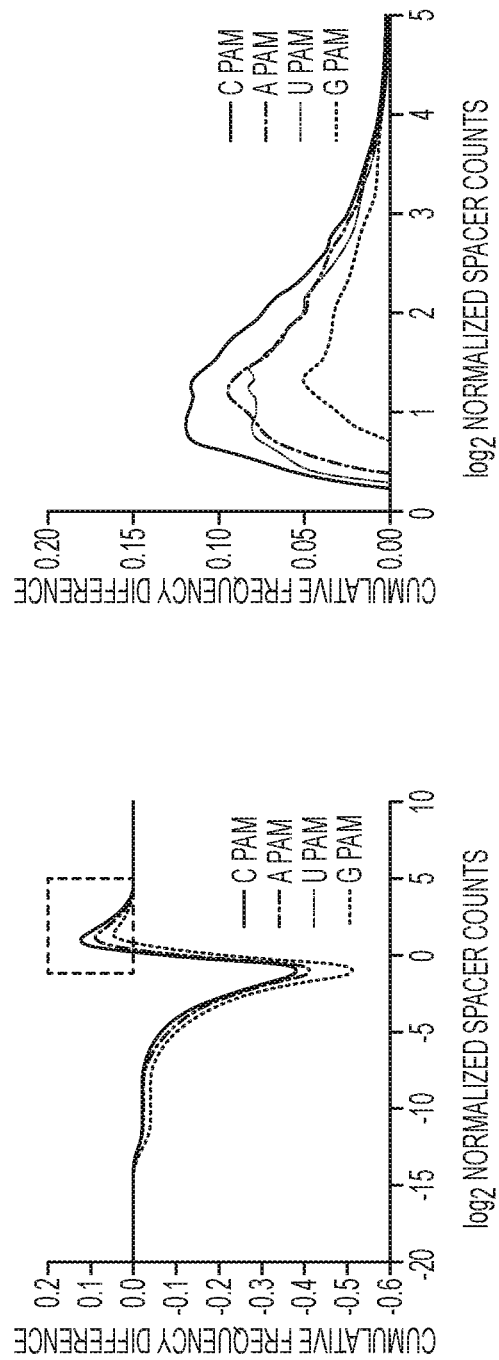

FIG. 128A-128G. MS2 phage screen spacer representation across each PAM. FIG. 128A Box plot showing the distribution of spacer frequencies with spacers grouped by their 3' PAM for phage treated conditions. Box extends from the first to third quartile with the whiskers denoting the 1st percentile and 99th percentile. **, $p<0.0001$. FIG. 128B Multiple comparison test (ANOVA with Tukey correction) between all possible PAM pairs for the phage treated spacer distributions. Plotted are the confidence intervals for difference in means between the compared PAM pairs. FIG. 128C Box plot showing the distribution of spacer frequencies with spacers grouped by their 3' PAM for non-phage treated conditions. Box extends from the first to third quartile with the whiskers denoting the 1st percentile and 99th percentile. , $p<0.0001$. FIG. 128D Multiple comparison test (ANOVA with Tukey correction) between all possible PAM pairs for the non-phage treated spacer distributions. Plotted are the confidence intervals for difference in means between the compared PAM pairs. FIG. 128E Cumulative frequency plots for the log 2 normalized spacer counts. Spacers are separated by respective PAM to show the enrichment differences between each PAM distribution. FIG. 128F The average cumulative frequency difference between the phage and no phage cumulative frequency curves. The differences are shown for each PAM distribution. FIG. 128G A zoomed in plot of the dotted box in (128F**) to highlight the variation in enrichment between the different PAMs.

Figure 129A:
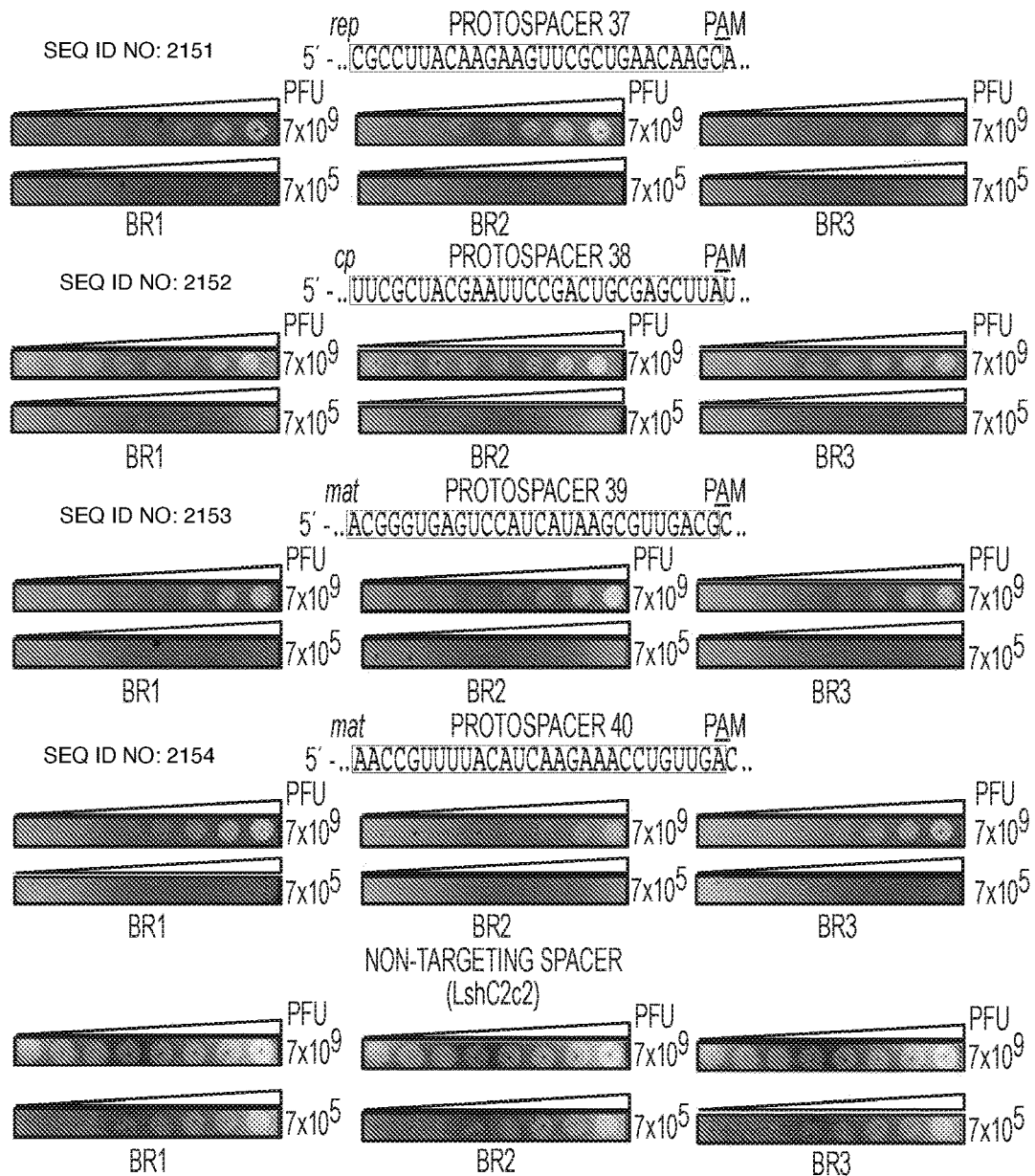
Figure 129B:
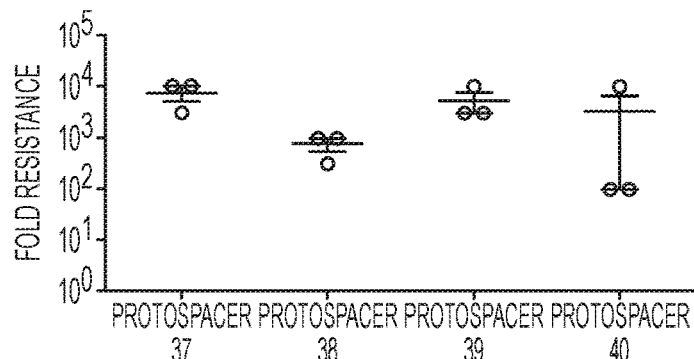

FIG. 129A-129B. Top hits from MS2 phage screen show interference in plaque assay. FIG. 129A Images from validation of MS2 screen by plaque assay showing reduced plaque formation in top hits. Phage dilutions were spotted on bacteria plates at decreasing numbers of plaque forming units (PFU). Spacer targets are shown above images; biological replicates are labeled BR1, BR2, or BR3. Non-targeting control is the native LshC2c2 locus. FIG. 129B Quantitation of MS2 plaque assay demonstrating interference by top hits. Interference was quantified by highest dilution without plaques. FIG. 129A discloses SEQ ID NOS 2151-2154, respectively, in order of appearance.

Figure 2:
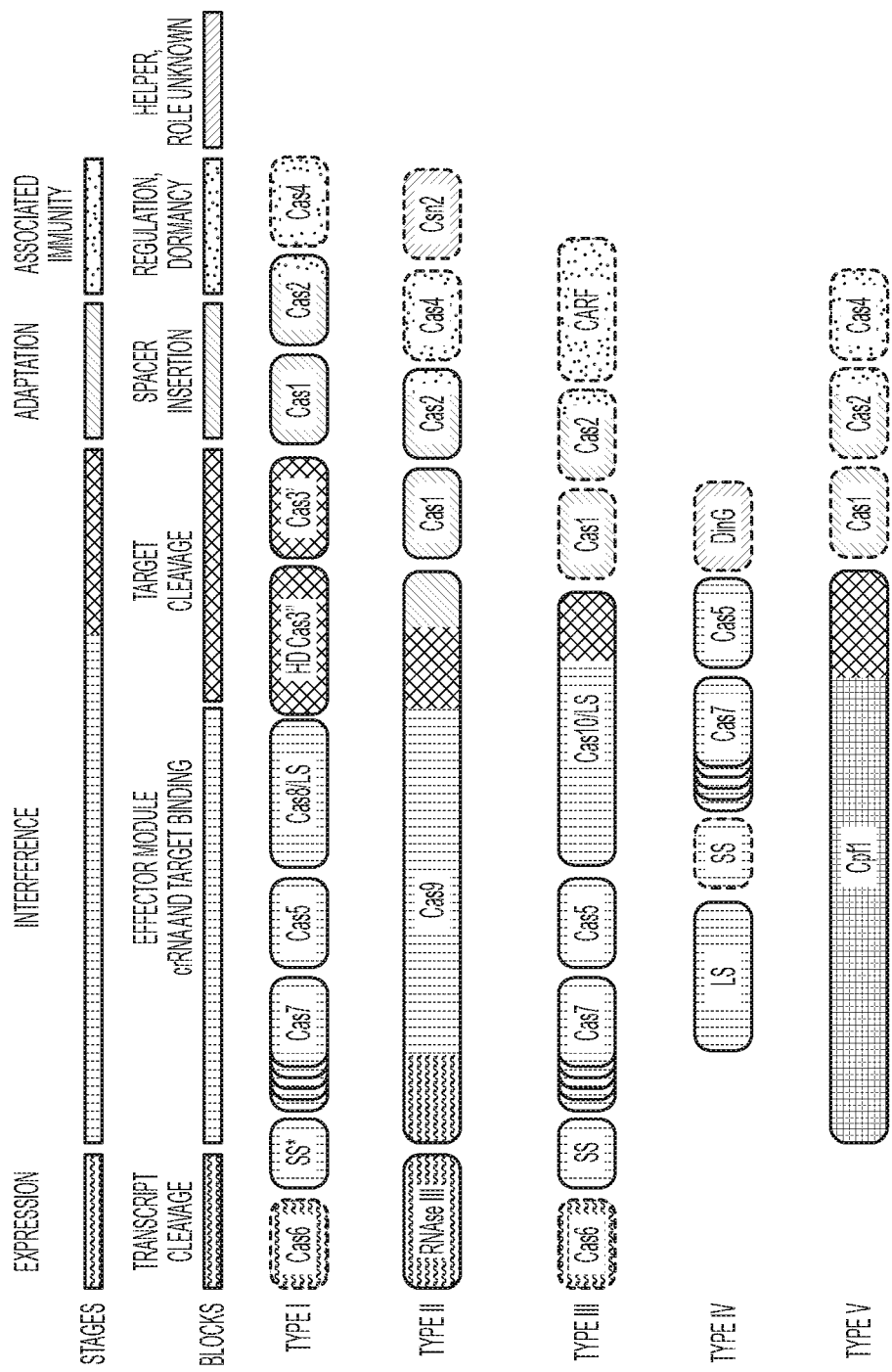
FIG. 2 provides a molecular organization of CRISPR-Cas.
Figure 3A:
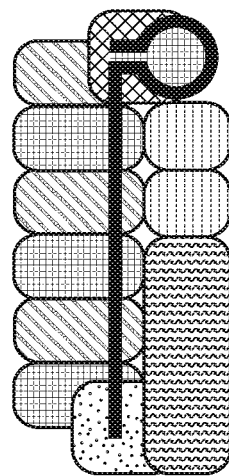
FIGS. 3A-3D provides structures of Type I and III effector complexes: common architecture/common ancestry despite extensive sequence divergence.
Figure 3B:
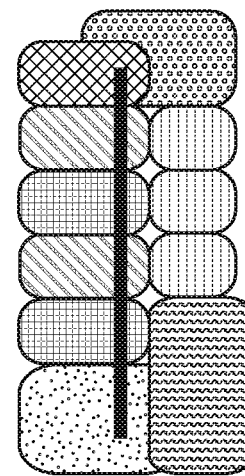
Figure 3C:
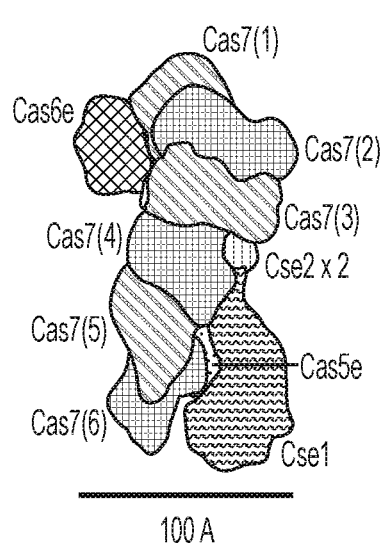
Figure 3D:
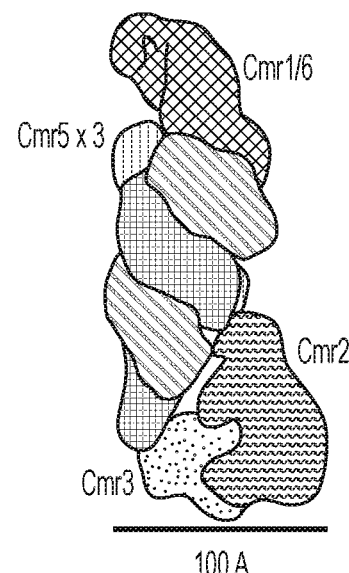
Figures 1, 13A:
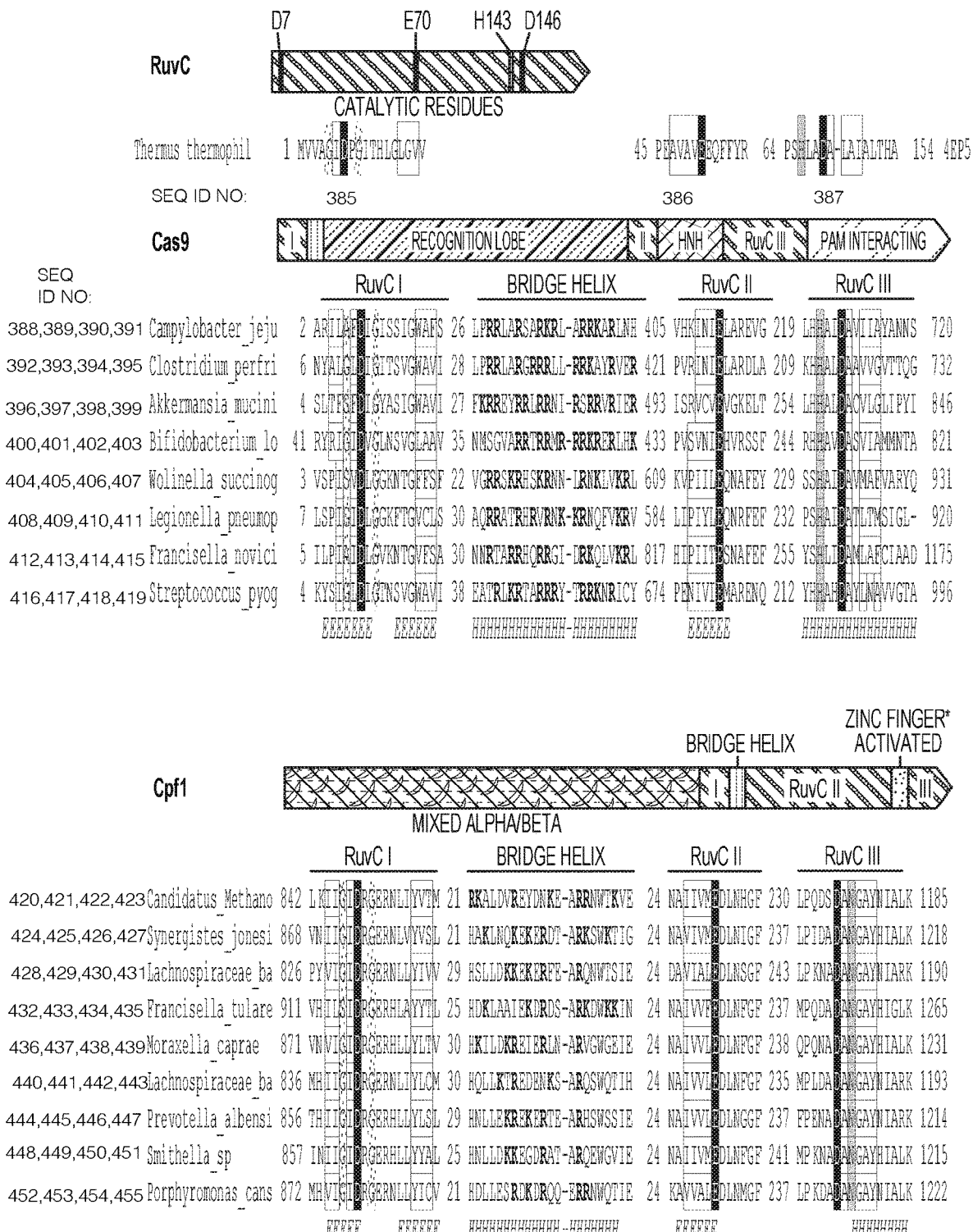
Figure 13A:
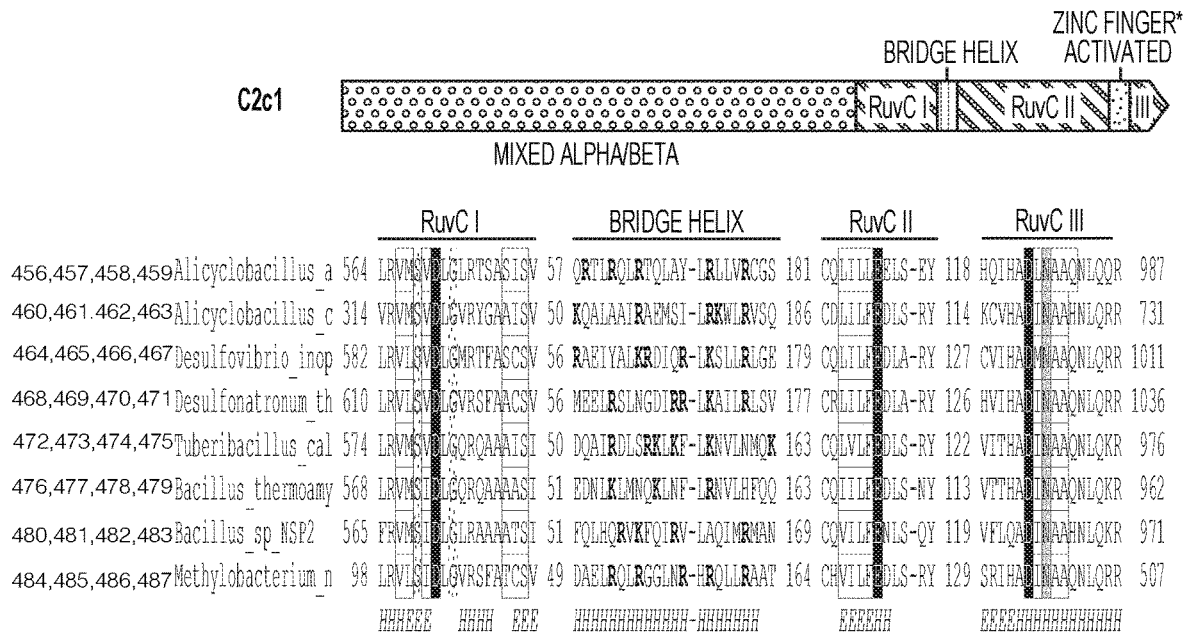
Figure 2:
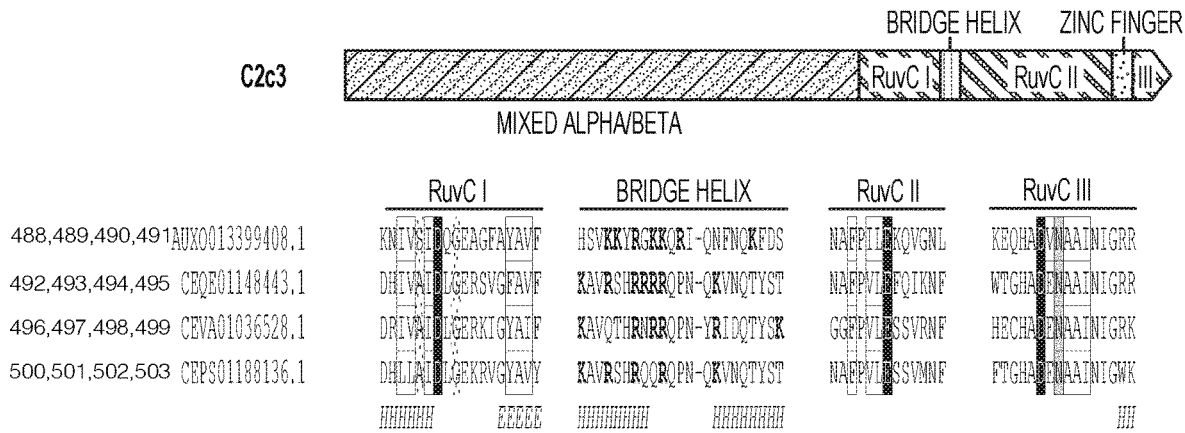
Figure 13B:
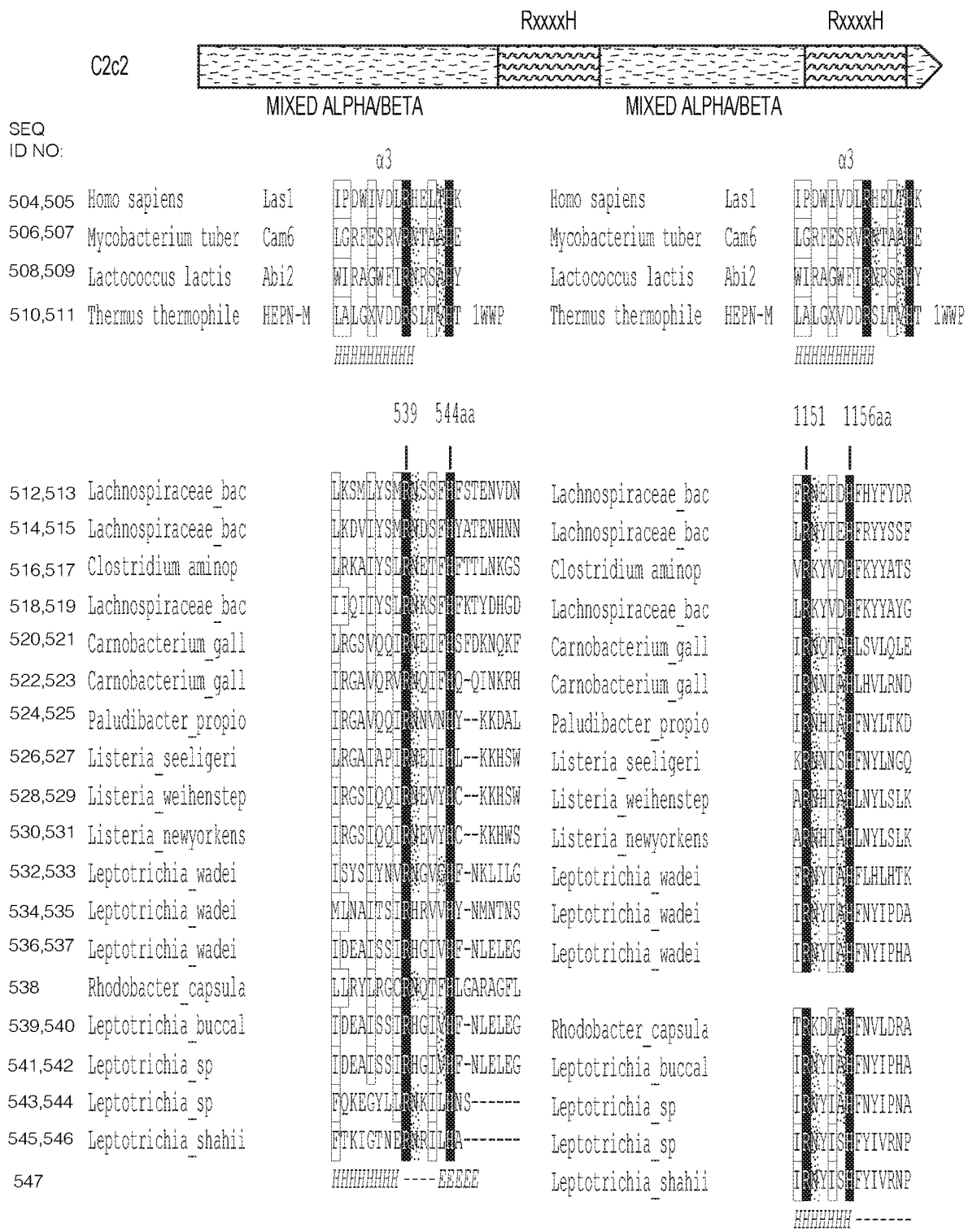
Figures 1, 130:
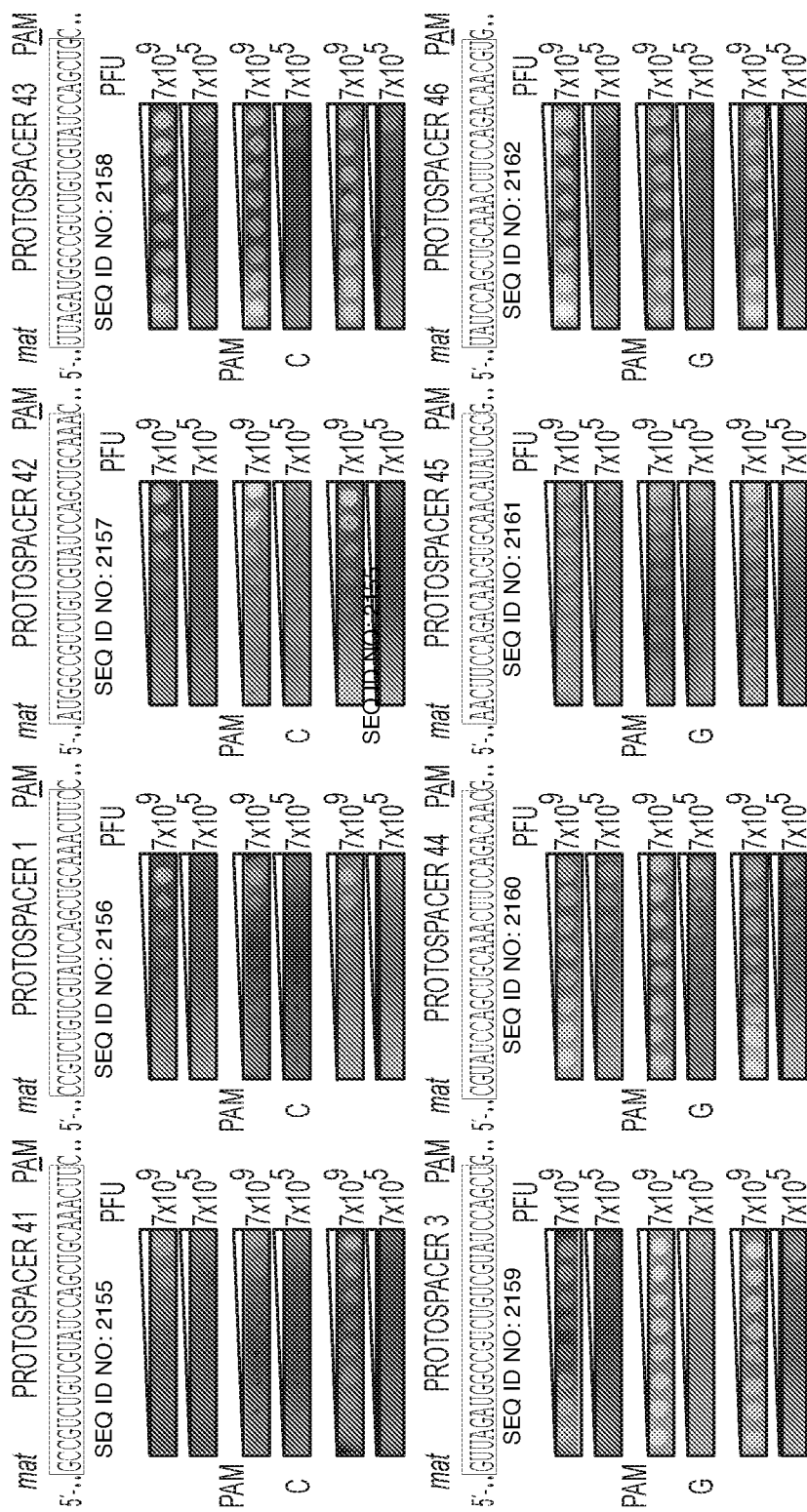
Figures 2, 130:
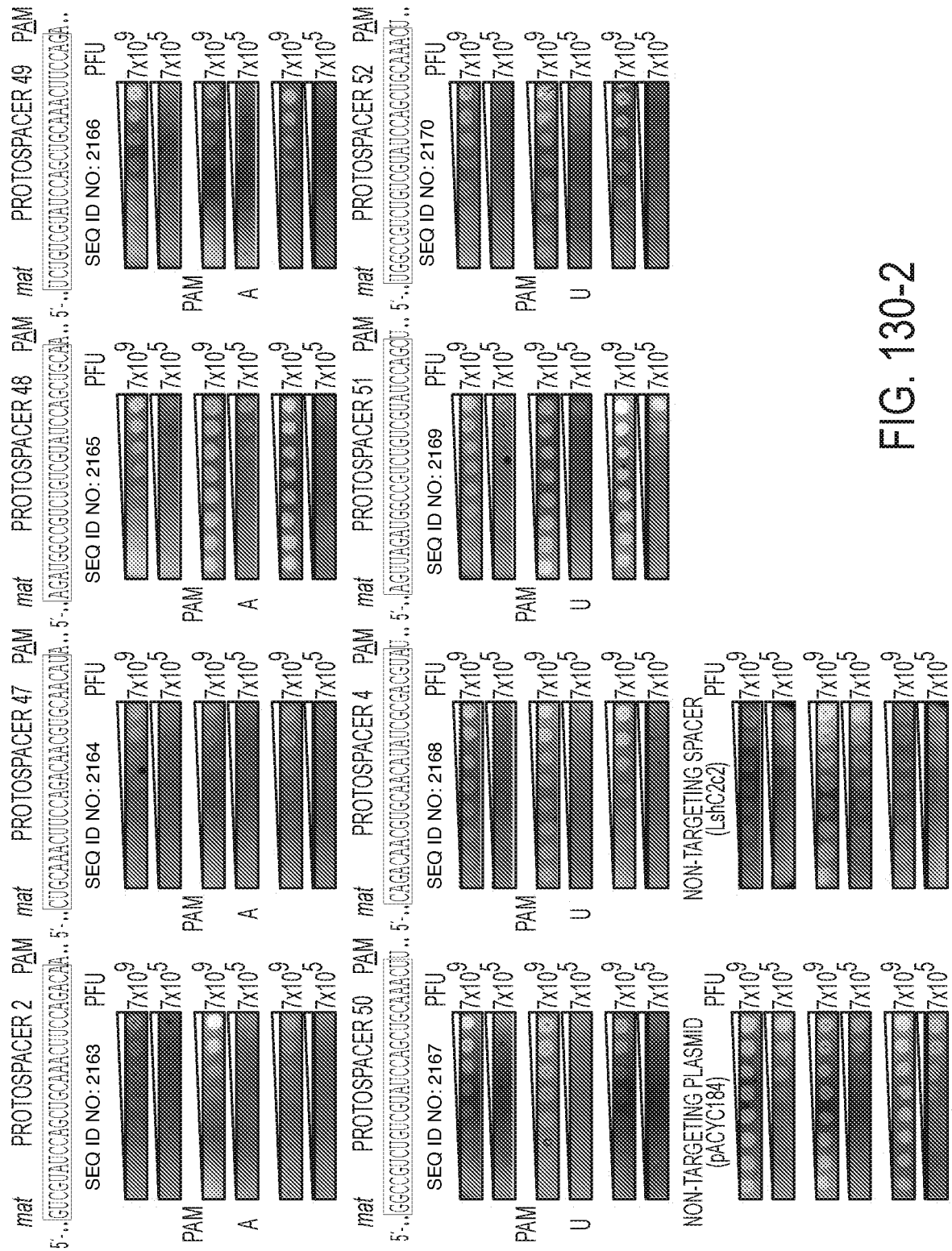

FIG. 130-1-130-2. MS2 plaque assay validates the 3' H PAM. Four spacers for each possible 3' PAM (A, G, C, and U) are cloned into the pLshC2c2 vector and tested for MS2 phage restriction in a plaque forming assay. The images show significantly reduced plaque formation for A, C, and U PAMs, and less restriction for the G PAM. Phage dilutions were spotted on bacteria plates at decreasing numbers of plaque forming units (PFU). Spacer targets are shown above images; three biological replicates are vertically stacked under each protospacer sequence. Non-targeting controls are the native LshC2c2 locus and the pACYC184 backbone. Figure discloses SEQ ID NOS 2155-2170, respectively, in order of appearance.

FIG. 131A-131D. Protein purification of LshC2c2. FIG. 131A Coomassie blue stained acrylamide gel of purified LshC2c2 stepwise purification. A strong band just above 150 kD is consistent with the size of LshC2c2 (171 kD). FIG. 131B Size exclusion gel filtration of LshC2c2. LshC2c2 eluted at a size approximately >160 kD (62.9 mL). FIG. 131C Protein standards used to calibrate the Superdex 200 column. BDex=Blue Dextran (void volume), Ald=Aldolase (158 kD), Ov=Ovalbumin (44 kD), RibA=Ribonuclease A (13.7 kD), Apr=Aprotinin (6.5 kD). FIG. 131D Calibration curve of the Superdex 200 column. Kay is calculated as (elution volume−void volume)/(geometric column volume−void volume). Standards were plotted and fit to a logarithmic curve.

Figure 132A:
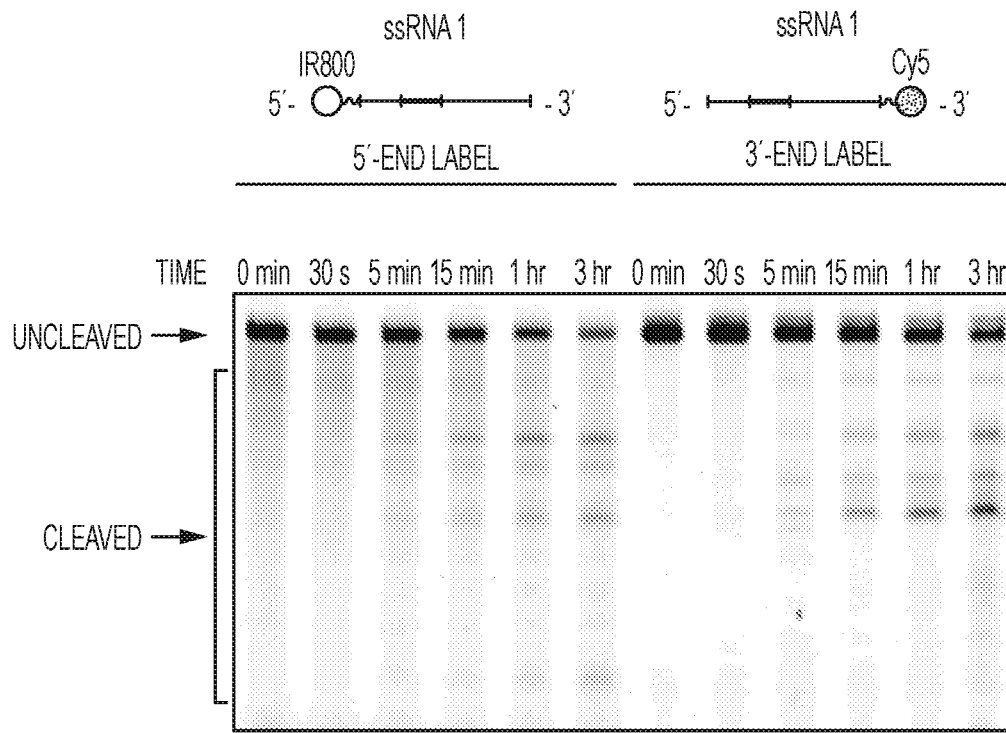
Figure 132B:
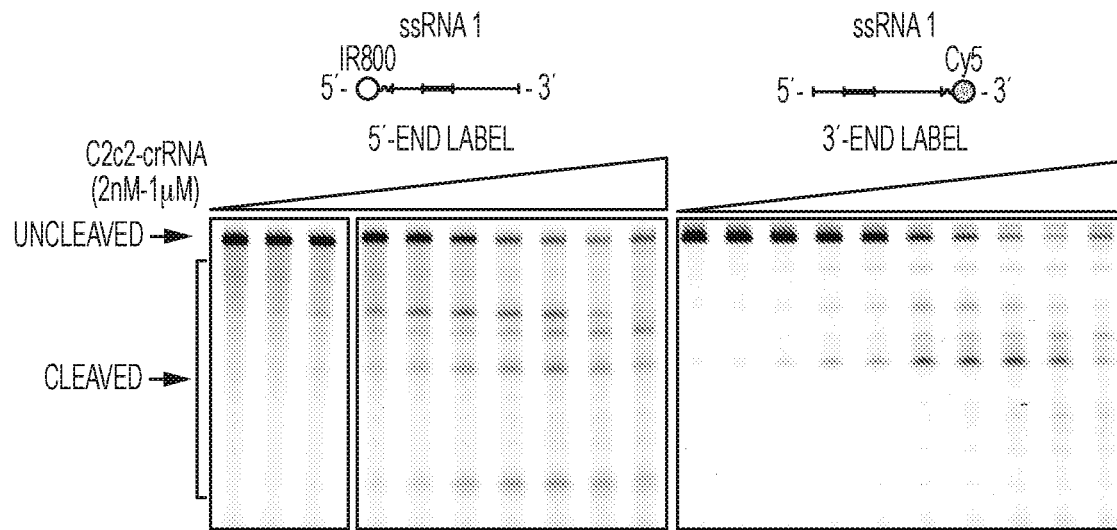

FIG. 132A-132B. Further in vitro characterization of the RNA cleavage kinetics of LshC2c2. FIG. 132A A time series of LshC2c2 ssRNA cleavage using a 5'- and 3-end-labeled target 1. FIG. 132B RNA-cleavage of 5'- and 3-end-labeled target 1 using LshC2c2-crRNA complex that is serially diluted in half-log steps.

Figure 133:
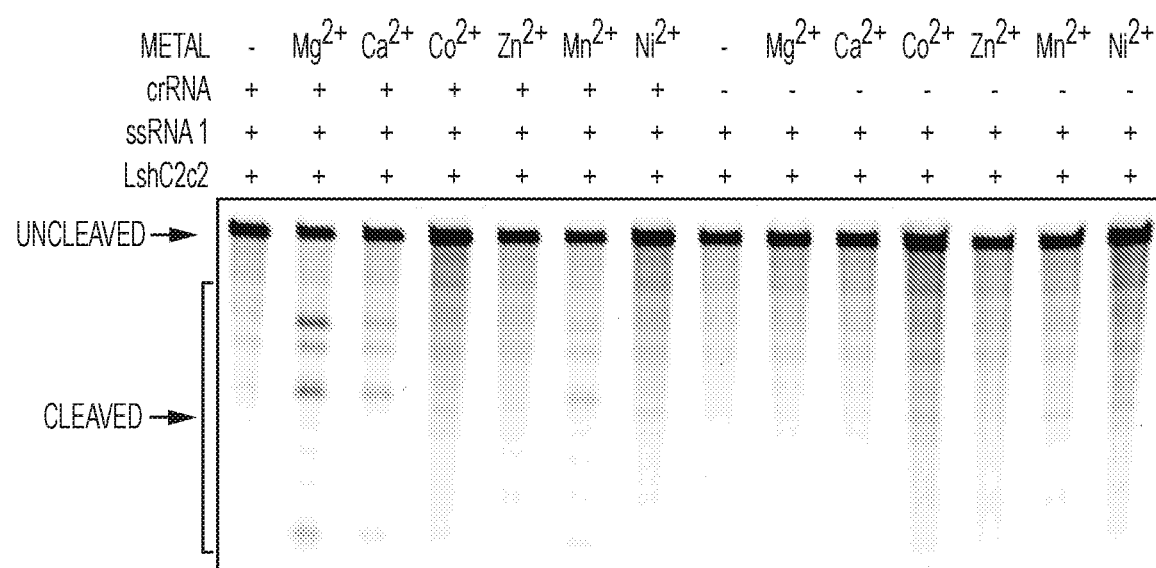

FIG. 133. Characterization of the metal dependence of LshC2c2 RNA cleavage. A variety of divalent metal cations are supplemented for the LshC2c2 cleavage reaction using 5'-end-labeled target 1. Significant cleavage is only observed for Mg+2. Weak cleavage is observed for Ca+2 and Mn+2.

Figure 134A:
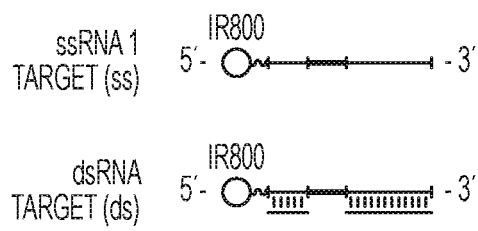
Figure 134B:
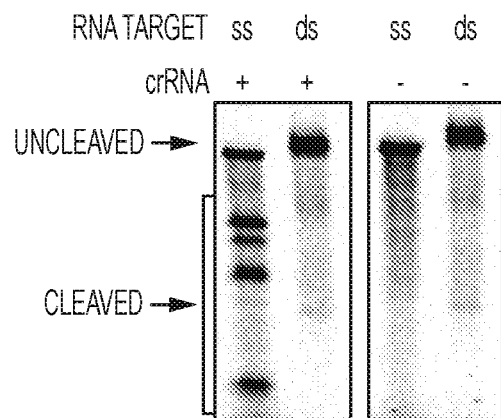
Figure 134C:
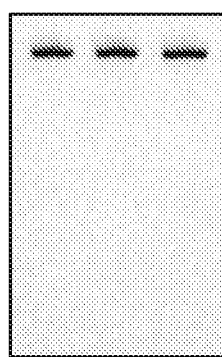
Figure 134D:
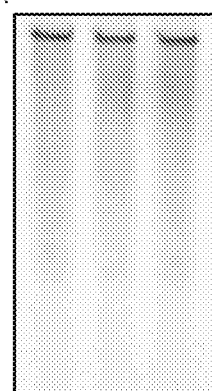

FIG. 134A-134D. LshC2c2 has no observable cleavage activity when using dsRNA, dsDNA, or ssDNA substrates. FIG. 134A A schematic of the partial dsRNA target. 5'-end-labeled target 1 is annealed to two shorter RNAs that are complementary to the regions flanking the protospacer site. This partial dsRNA is a more stringent test for dsRNA cutting since it should still allow for LshC2c2 complex binding to ssRNA. FIG. 134B LshC2c2 cleavage activity of a dsRNA target shown in (134A) compared to the ssRNA target 1. No cleavage is observed when using the dsRNA substrate. FIG. 134C LshC2c2 cleavage of a dsDNA plasmid library. A plasmid library was generated to have seven randomized nucleotides 5' of protospacer 14 to account for any sequence requirements for dsDNA cleavage. No cleavage is observed for this dsDNA library. FIG. 134D A ssDNA version of target 1 is tested for cleavage by LshC2c2. No cleavage is observed.

Figure 135A:
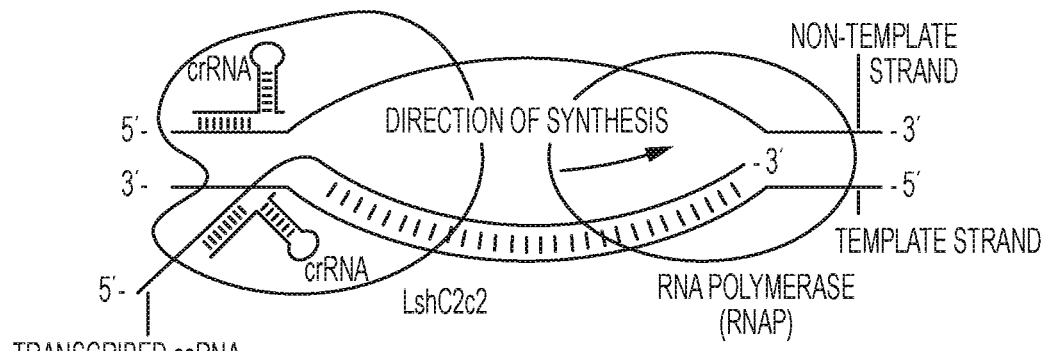
Figure 135B:
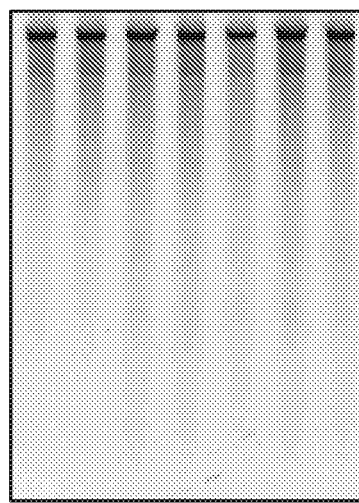

FIG. 135A-135B. LshC2c2 has no observable cleavage activity on dsDNA targets in a co-transcriptional cleavage assay. FIG. 135A Schematic of co-transcriptional cleavage assay. C2c2 was incubated with E. coli RNA polymerase (RNAP) elongation complexes and rNTP as previously described (P. Samai et al., Co-transcriptional DNA and RNA Cleavage during Type III CRISPR-Cas Immunity. Cell 161, 1164-1174 (2015)). FIG. 135B LshC2c2 cleavage of DNA target after co-transcriptional cleavage assay. No cleavage is observed.

Figure 136:
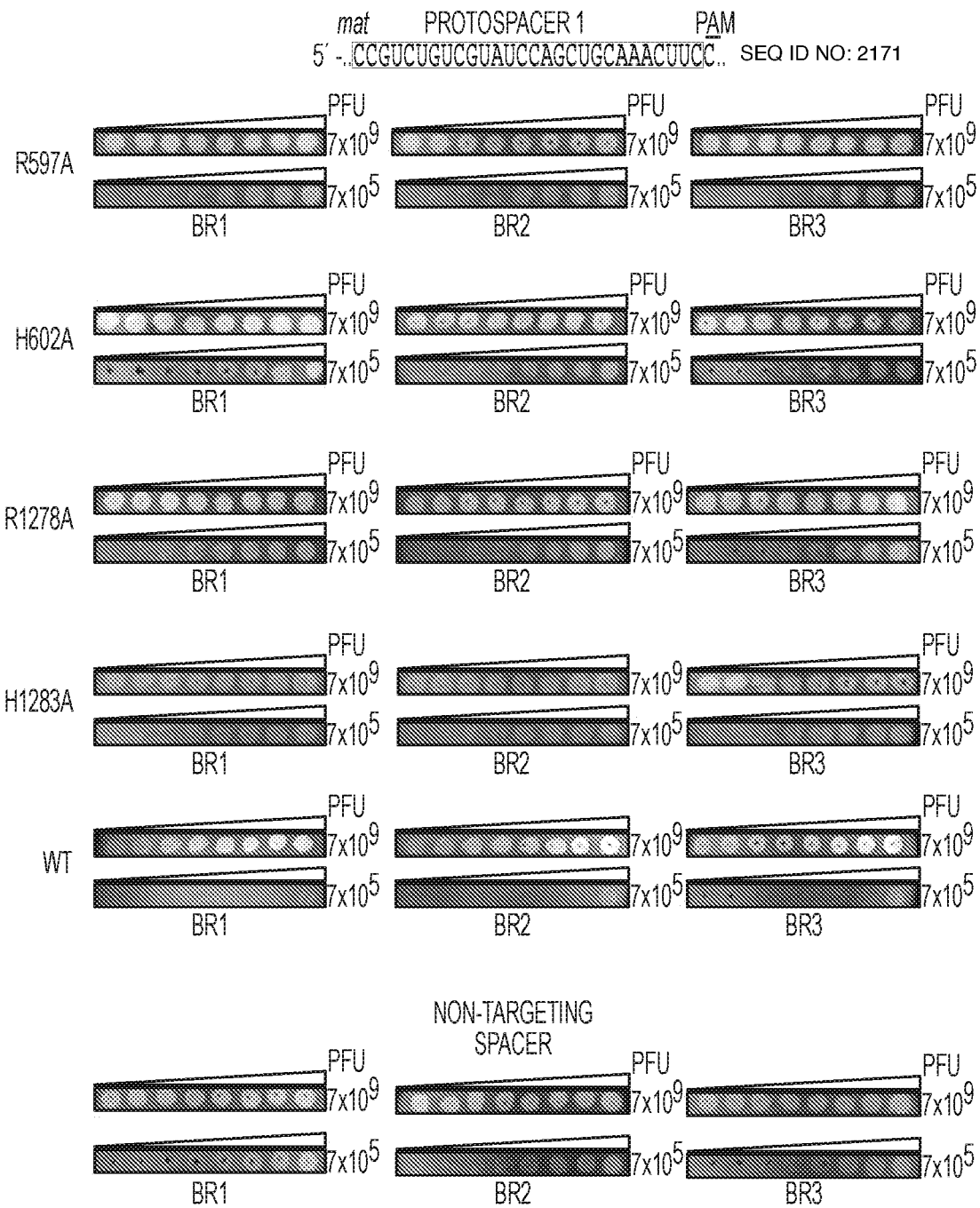

FIG. 136. MS2 restriction assay reveals that single HEPN mutants abrogate LshC2c2 activity. All four possible single HEPN mutants were generated in the pLshC2c2 vector (R597A, H602A, R1278A, and H1283A) with protospacer 1. Images from plaque assay testing these HEPN mutant loci show similar plaque formation to the non-targeting locus and is significantly higher than the WtC2c2 locus. Phage dilutions were spotted on bacteria plates at decreasing numbers of plaque forming units (PFU). Spacer targets are shown above images; biological replicates are labeled BR1, BR2, or BR3. Non-targeting control is the native LshC2c2 locus. Figure discloses SEQ ID NO: 2171.

Figure 137A:
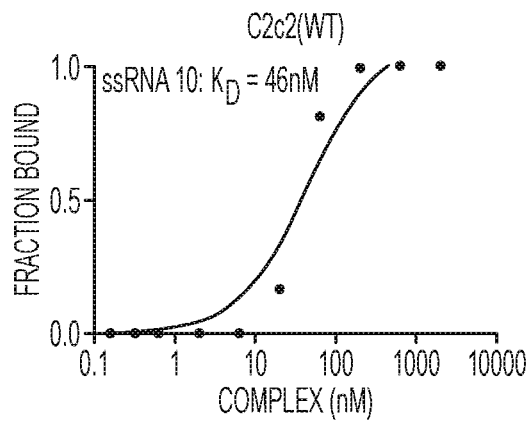
Figure 137B:
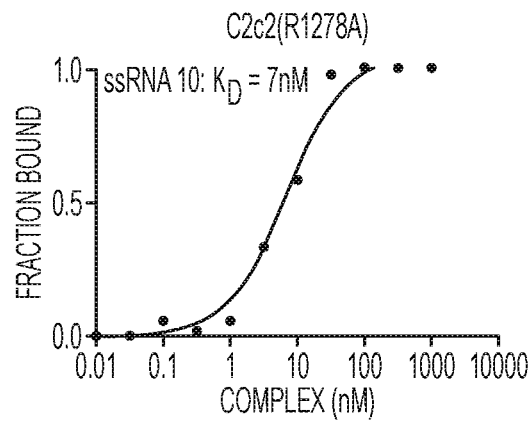
Figure 137C:
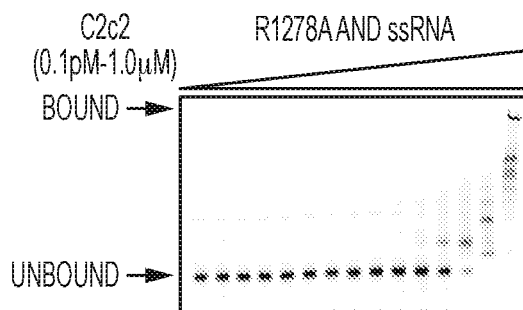
Figure 137D:
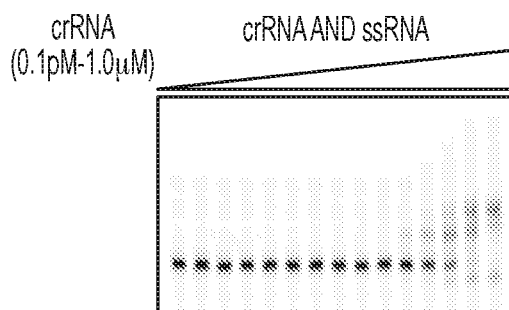
Figure 137E:
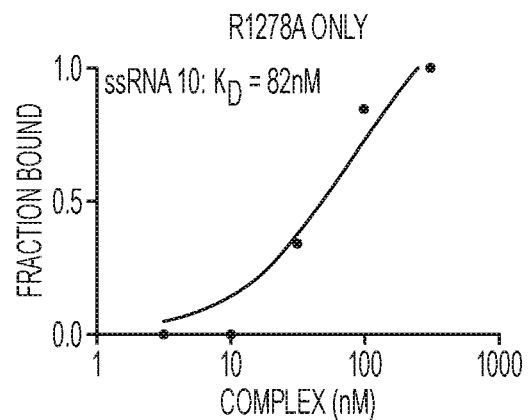
Figure 137F:
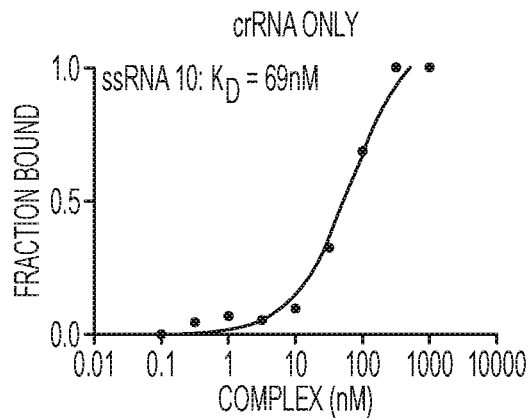

FIG. 137A-137F. Quantitation of LshC2c2 binding. FIG. 137A Calculation of binding affinity for wildtype LshC2c2-crRNA complex and on-target ssRNA. Fraction of protein bound was quantified by densitometry from FIG. 4D and KD was calculated by fitting to binding isotherm. FIG. 137B Calculation of binding affinity for HEPN mutant R1278A LshC2c2-crRNA complex and on-target ssRNA. Fraction of protein bound was quantified by densitometry from FIG. 4E and KD was calculated by fitting to binding isotherm. FIG. 137C Electrophoretic mobility shift assay with HEPN mutant R1278A LshC2c2 against on-target ssRNA in the absence of crRNA. EDTA is supplemented to reaction condition. FIG. 137D Electrophoretic mobility shift assay crRNA against on-target ssRNA. EDTA is supplemented to reaction condition. FIG. 137E Calculation of binding affinity for HEPN mutant R1278A LshC2c2 and on-target ssRNA in the absence of crRNA. Fraction of protein bound was quantified by densitometry from Fig. S12C and KD was calculated by fitting to binding isotherm. FIG. 137F Calculation of binding affinity for crRNA and on-target ssRNA. Fraction of crRNA bound was quantified by densitometry from Fig. S12D and KD was calculated by fitting to binding isotherm.

Figure 138:
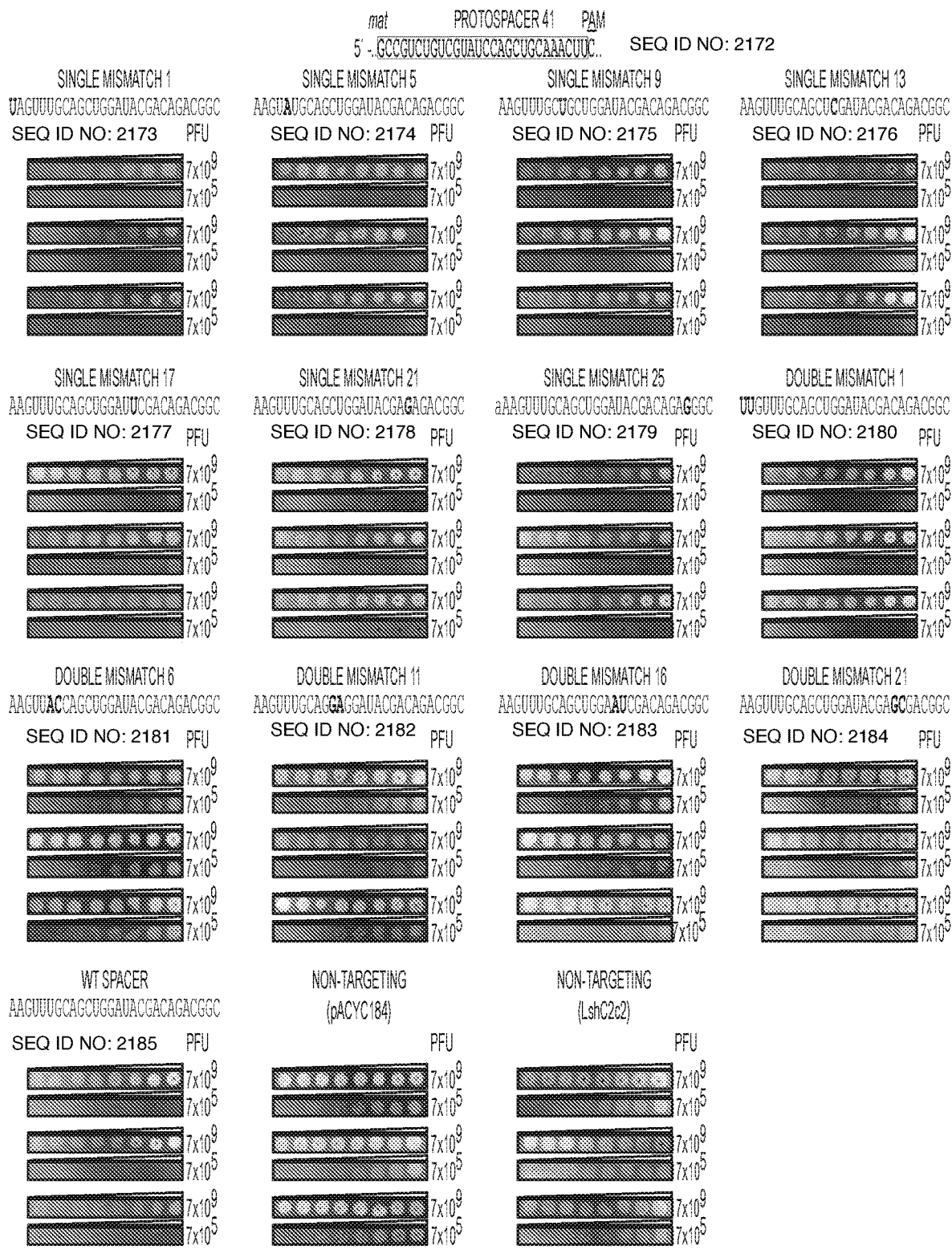

FIG. 138. MS2 restriction assay testing the effect of single and double mismatches on LshC2c2 activity. pLshC2c2 with protospacer 41 was modified to have a series of single mismatches and consecutive double mismatches as shown. Images from plaque assay testing these mismatched spacers reveals reduced plaque formation for the single-mismatch spacers on-par with the fully complementary spacer. The double mismatch spacers show increased plaque formation for a seed region in the middle of spacer sequence. Phage dilutions were spotted on bacteria plates at decreasing numbers of plaque forming units (PFU). Spacer targets are shown above images; biological replicates are labeled BR1, BR2, or BR3. Non-targeting control is the native LshC2c2 locus. Figure discloses SEQ ID NOS 2173-2185, respectively, in order of appearance.

Figure 139:
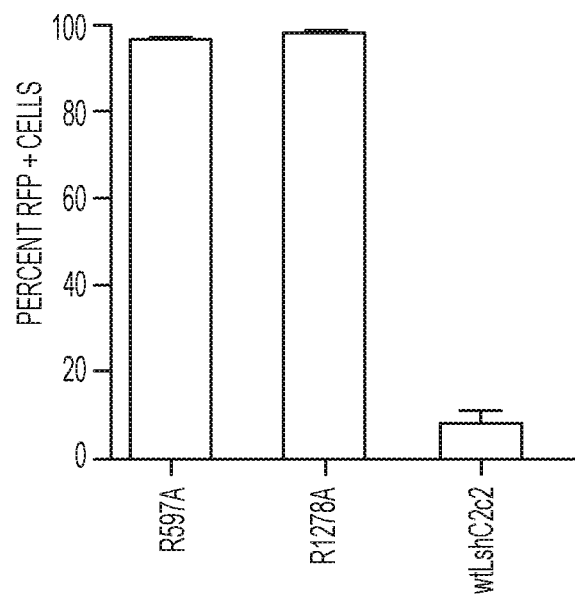

FIG. 139. HEPN mutant LshC2c2 are tested for RFP mRNA targeting activity. The pLshC2c2 vector with protospacer 36 was modified to have the single HEPN mutants R597A and R1278A (one in each of the HEPN domains). These mutations resulted in little detectable RFP knockdown as measured by flow cytometry on the E. coli. Figure discloses SEQ ID NOS 2186-2187, respectively, in order of appearance.

FIG. 140A-140B. Biochemical characterization of the collateral cleavage effect. FIG. 140A LshCc2 is incubated with a crRNA targeting protospacer 14 with and without unlabeled ssRNA target 1 (contains protospacer 14). When LshC2c2 is in the presence of target 1, significant cleavage activity is observed for fluorescently labeled non-complementary targets 6-9. FIG. 140B HEPN mutant collateral activity is compared to WT C2c2. The proteins are incubated with crRNA complementary to protospacer 14 and with and without unlabeled homopolymer targets 2 or 3 (both containing protospacer 14). The collateral effect is no longer observed with the HEPN mutant proteins on the fluorescently labeled non-complementary target 8.

Figure 141A:
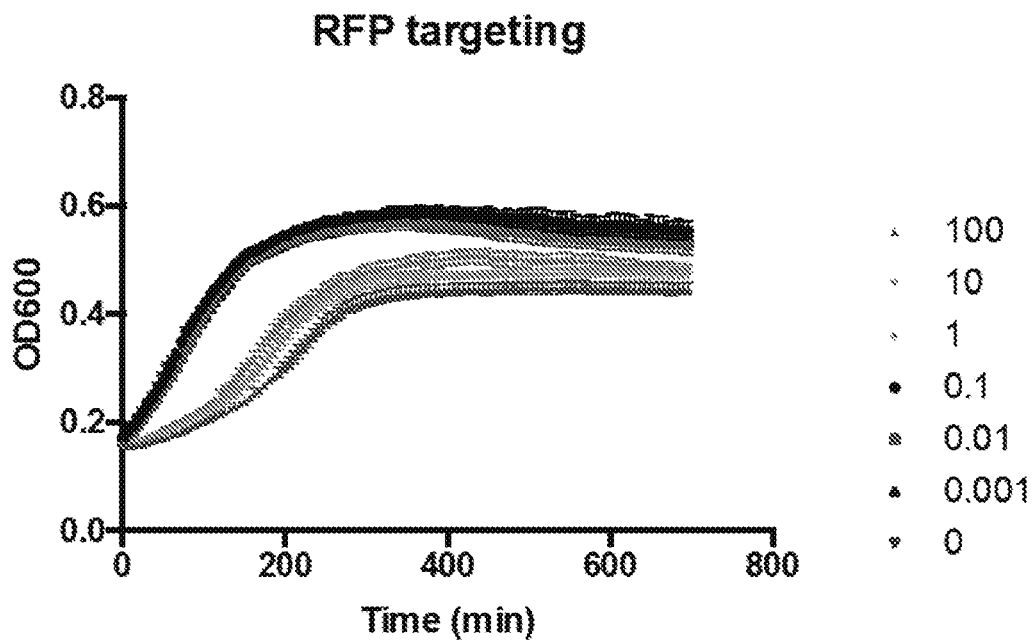
Figure 141B:
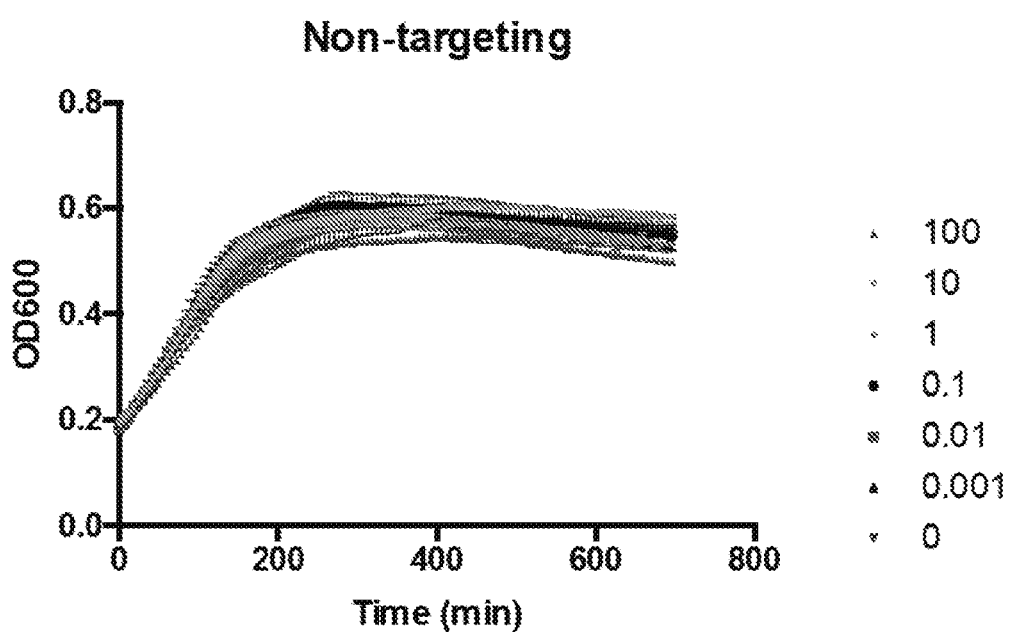

FIG. 141A-141B. Growth suppression is correlated with RFP knockdown in cells that express C2c2 and RFP-targeting crRNA. FIG. 141A shows the effect on growth of inducible RFP expression in E. coli expressing C2c2 and a crRNA that targets RFP. RFP was expressed using an anhydrotetracycline (aTc)-inducible gene expression system. Cell cultures were treated with aTc at the concentrations indicated. Increasing aTc expression suppressed growth. FIG. 141B shows the effect on growth of inducible RFP expression when a non-targeting crRNA was substituted for the RFP-targeting crRNA.

Figure 142A:
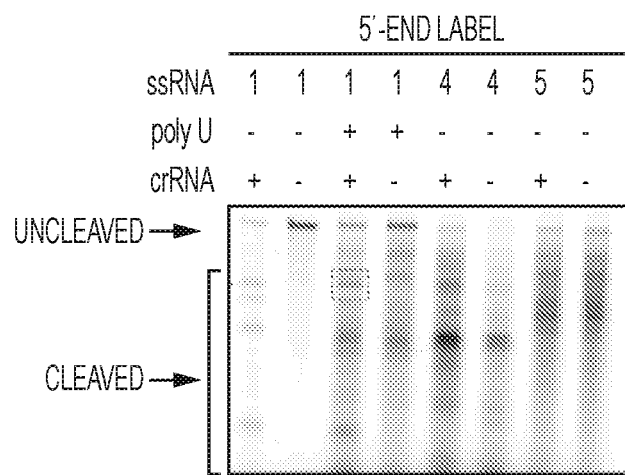
Figure 142B:
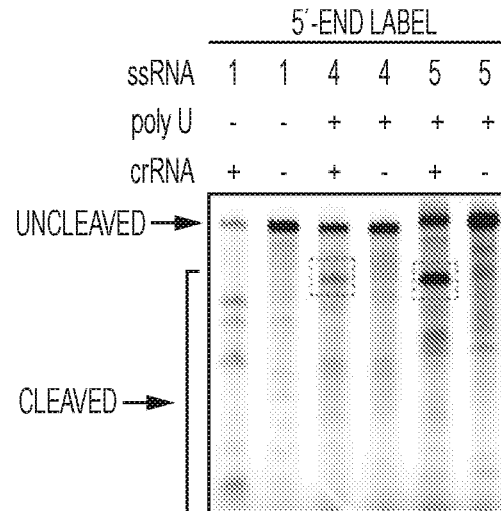
Figure 142C:
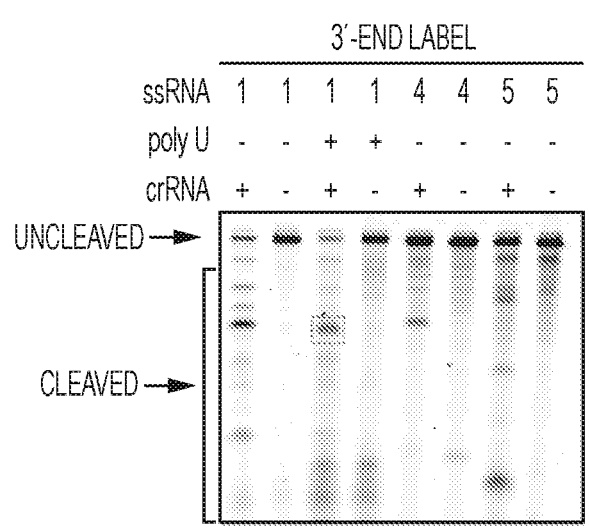
Figure 142D:
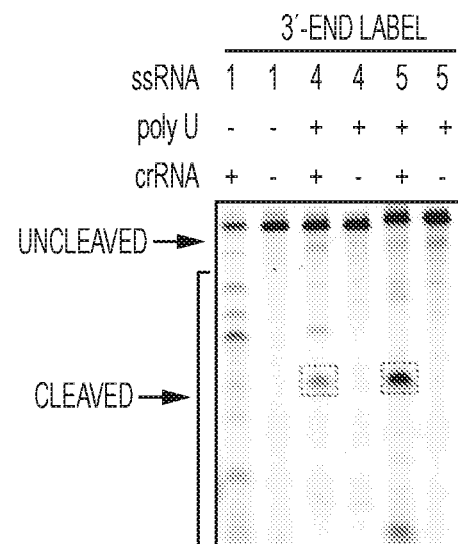

FIG. 142A-142D. C2c2 preferentially cleaves at poly U tracts. ssRNA cleavage by C2c2 was examined using ssRNA substrate containing or lacking a poly U tract. End-labeled ssRNA was incubated with C2c2 and crRNA and digestion products resolved. Poly U-containing substrate RNA was efficiently cleaved. Substrate cleavage was crRNA-dependent as shown by absence of digestion products when C2c2 but not crRNA was present. FIGS. 142A and 142B: 3'-end labeled substrate. FIGS. 142C and 142D: 5'-end labeled substrate. FIGS. 142 B and 142D indicate substrate cleavage was efficient and specific as substrate concentration was increased.

Figures 143A, 143B:
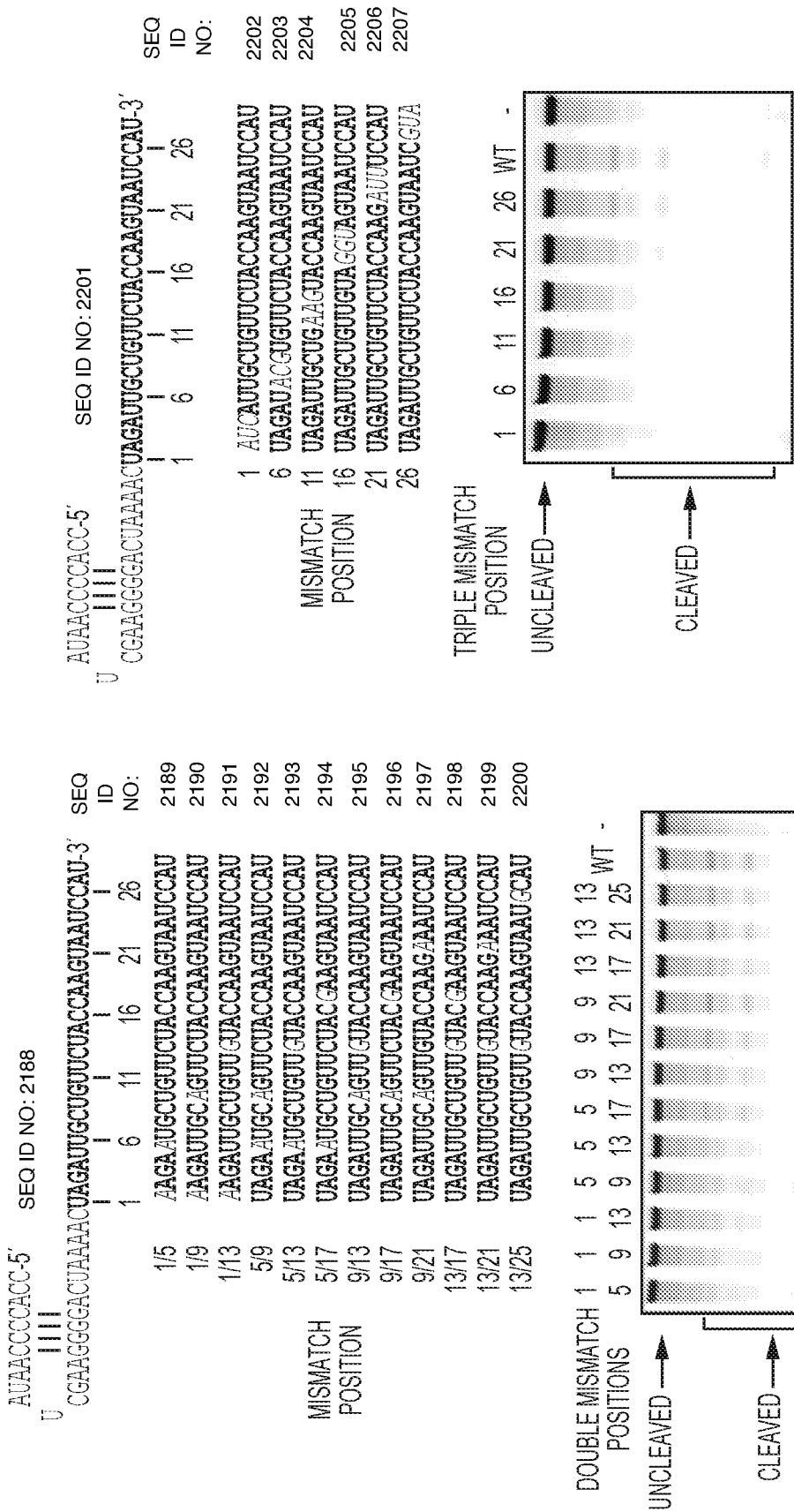

FIGS. 143A-143B. Cleavage of target RNA with mismatched crRNA is position dependent. ssRNA target was treated with crRNA containing double (FIG. 143A) or triple (FIG. 143B) mismatches and LshC2c2. Products of cleavage reactions were separated by electrophoresis. FIG. 143A discloses SEQ ID NOS 2188-2200, respectively, in order of appearance. FIG. 143B discloses SEQ ID NOS 2201-2207, respectively, in order of appearance.

Figure 144:
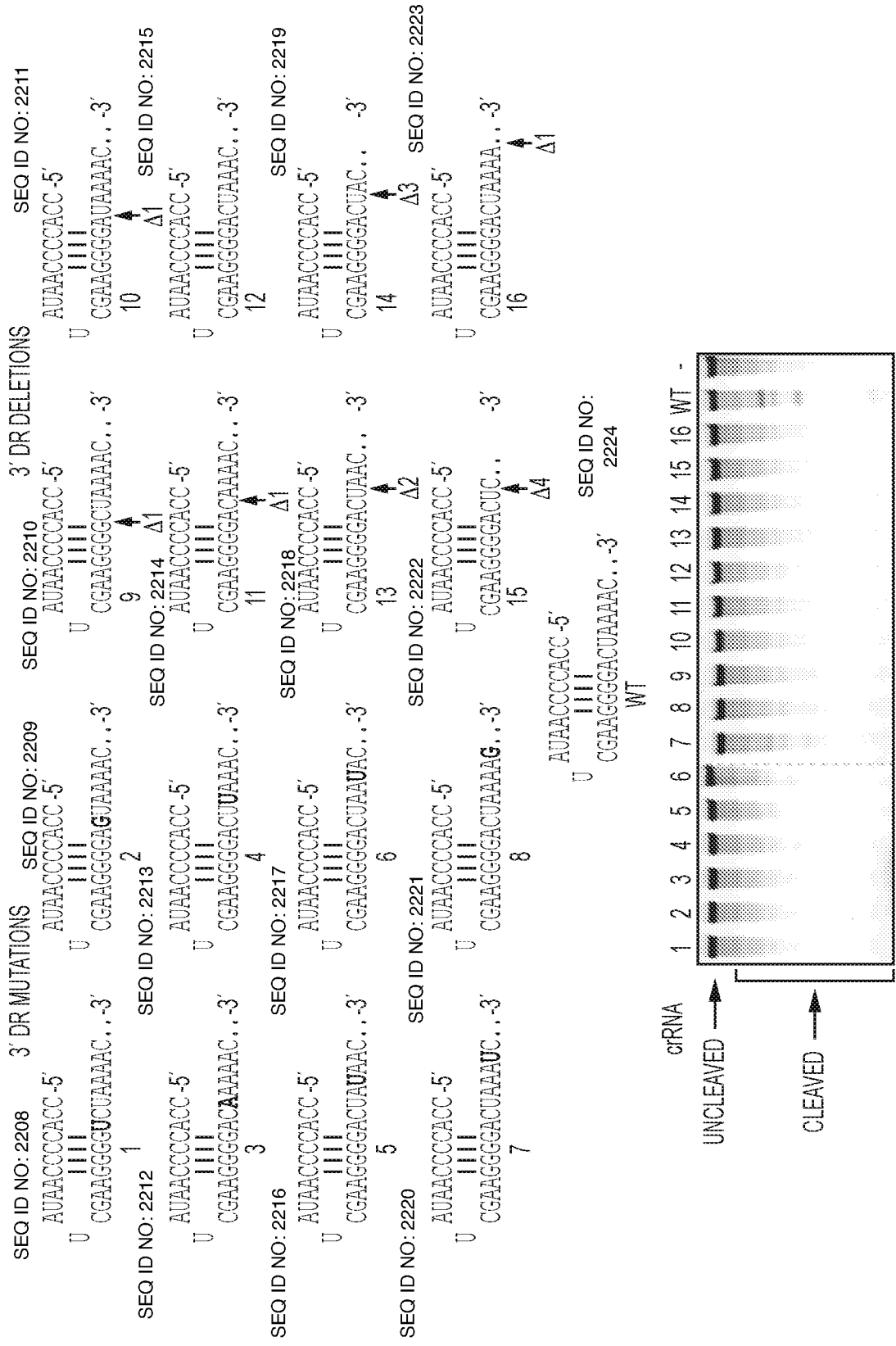

FIG. 144. Cleavage of target RNA is sensitive to mutations and deletions in the 3' direct repeat region. ssRNA target was treated with LshC2c2 and crRNA containing mismatches or deletions designed to disrupt secondary structure in the DR region. Products of cleavage reactions were separated by electrophoresis. FIG. 144 discloses SEQ ID NOS 2208-2224, respectively, in order of appearance.

Figure 145A:
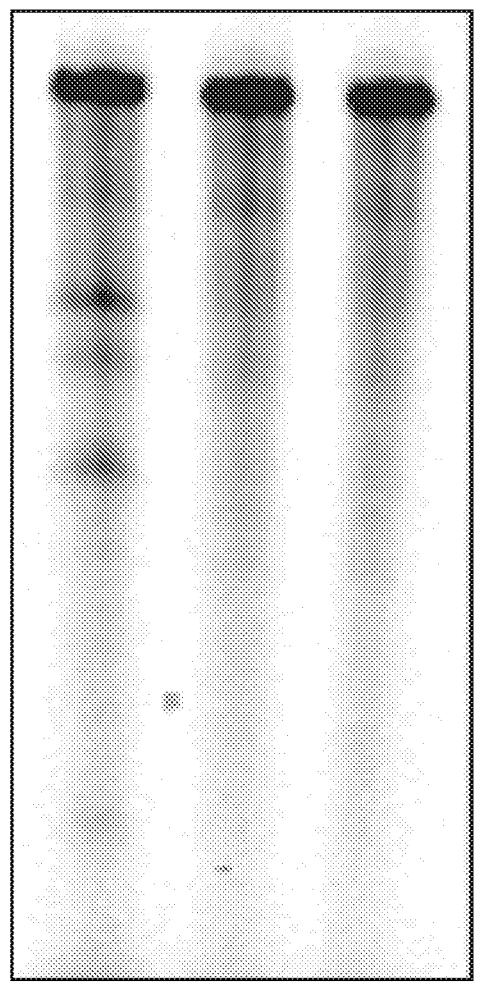
Figure 145B:
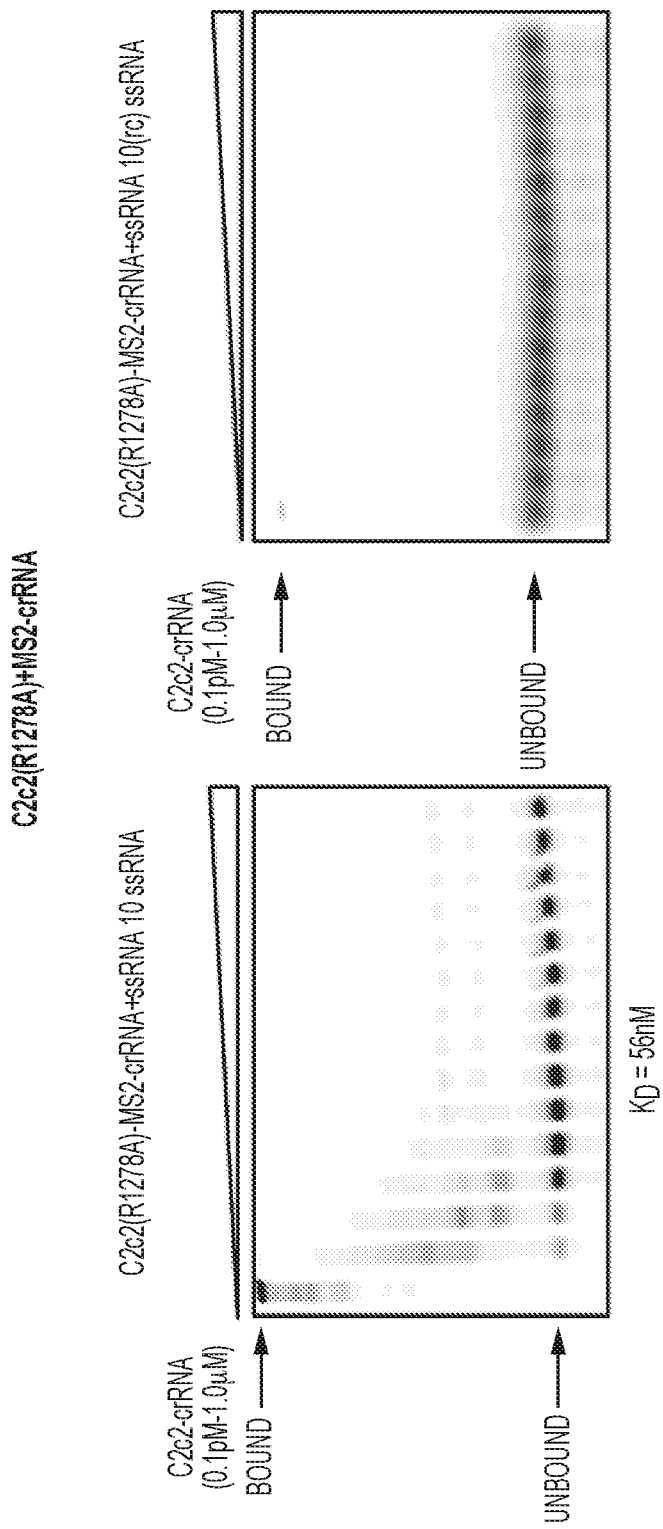

FIG. 145A-145B. C2c2 and MS2-crRNA can bind ssRNA. FIG. 145A: Binding of a LshC2c2(R1278A) which is defective for substrate cleavage, to ssRNA was tested. FIG. 145B: LshC2c2(R1278A) and MS2-crRNA were incubated with increasing amounts of labeled ssRNA 10 (left panel) or labeled reverse complement (RC) of ssRNA 10 (right panel). (See Table 10B for ssRNA 10 sequence).

Figure 146:
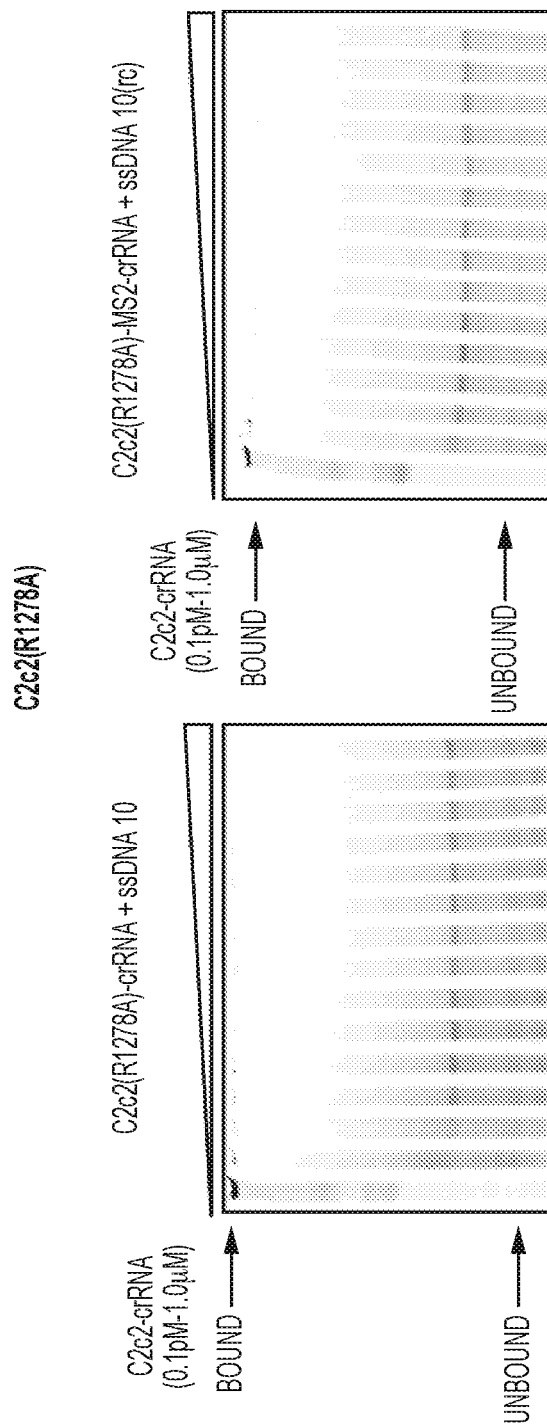

FIG. 146. C2c2 complex does not bind ssDNA. LshC2c2 (R1278A) and MS2-crRNA were incubated with increasing amounts of ssDNA 10 (left panel) or ssDNA 10 reverse complement (RC) (right panel). (See Table 10B for ssRNA 10 sequence).

The figures herein are for illustrative purposes only and are not necessarily drawn to scale.

DETAILED DESCRIPTION OF THE INVENTION

In general, a CRISPR-Cas or CRISPR system as used in the foregoing documents, such as WO 2014/093622 (PCT/US2013/074667) and refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a C2c2 protein, a tracrRNA is not required.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise any polynucleotide, such as DNA or RNA polynucleotides. In some embodiments, a target sequence is located in the nucleus or cytoplasm of a cell. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In embodiments of the invention the terms guide sequence and guide RNA, i.e. RNA capable of guiding Cas to a target genomic locus, are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at novocraft.com), ELAND (Illumina, San Diego, Calif.), SOAP (available at genomics.org), and Maq (available at sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In a classic CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In certain embodiments, modulations of cleavage efficiency can be exploited by introduction of mismatches, e.g. 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by choosing mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage.

The methods according to the invention as described herein comprehend inducing one or more nucleotide modifications in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s) or sgRNA(s). The mutations can include the introduction, deletion, or substitution of 1-75 nucleotides at each target sequence of said cell(s) via the guide(s) RNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 40, 45, 50, 75, 100, 200, 300, 400 or 500 nucleotides at each target sequence of said cell(s) via the guide(s) RNA(s).

For minimization of toxicity and off-target effect, it will be important to control the concentration of Cas mRNA or protein and guide RNA delivered. Optimal concentrations of Cas mRNA or protein and guide RNA can be determined by testing different concentrations in a cellular or non-human eukaryote animal model and using deep sequencing the analyze the extent of modification at potential off-target genomic loci.

Typically, in the context of an endogenous CRISPR system, formation of a CRISPR complex (comprising a guide sequence hybridized to a target sequence and complexed with one or more Cas proteins) results in cleavage in or near (e.g. within 1, 2, 3, 4, 5, 6, 7, 8, 9, 10, 20, 50, or more base pairs from) the target sequence.

The nucleic acid molecule encoding a Cas is advantageously codon optimized Cas. An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a Cas is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, P A), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas transgenic cell in which one or more nucleic acids encoding one or more guide RNAs are provided or introduced operably connected in the cell with a regulatory element comprising a promoter of one or more gene of interest. As used herein, the term "Cas transgenic cell" refers to a cell, such as a eukaryotic cell, in which a Cas gene has been genomically integrated. The nature, type, or origin of the cell are not particularly limiting according to the present invention. Also the way how the Cas transgene is introduced in the cell is may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference. The Cas transgene can further comprise a Lox-Stop-polyA-Lox (LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus, such as for instance one or more oncogenic mutations, as for instance and without limitation described in Platt et al. (2014), Chen et al., (2014) or Kumar et al. (2009).

In some embodiments, the Cas sequence is fused to one or more nuclear localization sequences (NLSs), such as about or more than about 1, 2, 3, 4, 5, 6, 7, 8, 9, 10, or more NLSs. In some embodiments, the Cas comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g. zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In a preferred embodiment of the invention, the Cas comprises at most 6 NLSs. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: X); the NLS from nucleoplasmin (e.g. the nucleoplasmin bipartite NLS with the sequence KRPAATKKAGQAKKKK) (SEQ ID NO: X); the c-myc NLS having the amino acid sequence PAAKRVKLD (SEQ ID NO: X) or RQRRNELKRSP (SEQ ID NO: X); the hRNPA1 M9 NLS having the sequence NQSSNFGPMKGGNFGGRSSGPYGGGGQYFAK-PRNQGGY(SEQ ID NO: X); the sequence RMRIZFKNKGKDTAELRRRRVEVSVELRKAKKD-EQILKRRNV (SEQ ID NO: X) of the IBB domain from importin-alpha; the sequences VSRKRPRP (SEQ ID NO: X) and PPKKARED (SEQ ID NO: X) of the myoma T protein; the sequence POPKKKPL (SEQ ID NO: X) of human p53; the sequence SALIKKKKKMAP (SEQ ID NO: X) of mouse c-abl IV; the sequences DRLRR (SEQ ID NO: X) and PKQKKRK (SEQ ID NO: X) of the influenza virus NS; the sequence RKLKKKIKKL (SEQ ID NO: X) of the Hepatitis virus delta antigen; the sequence REKKKFLKRR (SEQ ID NO: X) of the mouse Mx1 protein; the sequence KRKGDEVDGVDEVAKKKSKK (SEQ ID NO: X) of the human poly(ADP-ribose) polymerase; and the sequence RKCLQAGMNLEARKTKK (SEQ ID NO: X) of the steroid hormone receptors (human) glucocorticoid. In general, the one or more NLSs are of sufficient strength to drive accumulation of the Cas in a detectable amount in the nucleus of a eukaryotic cell. In general, strength of nuclear localization activity may derive from the number of NLSs in the Cas, the particular NLS(s) used, or a combination of these factors. Detection of accumulation in the nucleus may be performed by any suitable technique. For example, a detectable marker may be fused to the Cas, such that location within a cell may be visualized, such as in combination with a means for detecting the location of the nucleus (e.g. a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of CRISPR complex formation (e.g. assay for DNA cleavage or mutation at the target sequence, or assay for altered gene expression activity affected by CRISPR complex formation and/or Cas enzyme activity), as compared to a control no exposed to the Cas or complex, or exposed to a Cas lacking the one or more NLSs or NESs. In certain embodiments, other localization tags may be fused to the Cas protein, such as without limitation for localizing the Cas to particular sites in a cell, such as organells, such mitochondria, plastids, chloroplast, vesicles, golgi, (nuclear or cellular) membranes, ribosomes, nucleoluse, ER, cytoskeleton, vacuoles, centrosome, nucleosome, granules, centrioles, etc.

In certain aspects the invention involves vectors, e.g. for delivering or introducing in a cell Cas and/or RNA capable of guiding Cas to a target locus (i.e. guide RNA), but also for propagating these components (e.g. in prokaryotic cells). A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s); and, when a single vector provides for more than 16 RNA(s), one or more promoter(s) can drive expression of more than one of the RNA(s), e.g., when there are 32 RNA(s), each promoter can drive expression of two RNA(s), and when there are 48 RNA(s), each promoter can drive expression of three RNA(s). By simple arithmetic and well established cloning protocols and the teachings in this disclosure one skilled in the art can readily practice the invention as to the RNA(s) for a suitable exemplary vector such as AAV, and a suitable promoter such as the U6 promoter. For example, the packaging limit of AAV is ~4.7 kb. The length of a single U6-gRNA (plus restriction sites for cloning) is 361 bp. Therefore, the skilled person can readily fit about 12-16, e.g., 13 U6-gRNA cassettes in a single vector. This can be assembled by any suitable means, such as a golden gate strategy used for TALE assembly (genome-engineering.org/taleffectors/). The skilled person can also use a tandem guide strategy to increase the number of U6-gRNAs by approximately 1.5 times, e.g., to increase from 12-16, e.g., 13 to approximately 18-24, e.g., about 19 U6-gRNAs. Therefore, one skilled in the art can readily reach approximately 18-24, e.g., about 19 promoter-RNAs, e.g., U6-gRNAs in a single vector, e.g., an AAV vector. A further means for increasing the number of promoters and RNAs in a vector is to use a single promoter (e.g., U6) to express an array of RNAs separated by cleavable sequences. And an even further means for increasing the number of promoter-RNAs in a vector, is to express an array of promoter-RNAs separated by cleavable sequences in the intron of a coding sequence or gene; and, in this instance it is advantageous to use a polymerase II promoter, which can have increased expression and enable the transcription of long RNA in a tissue specific manner. (see, e.g., oxfordjournals.org/content/34/7/e53, nature.com/mtjournal/v16/n9/abs/mt2008l44a). In an advantageous embodiment, AAV may package U6 tandem gRNA targeting up to about 50 genes. Accordingly, from the knowledge in the art and the teachings in this disclosure the skilled person can readily make and use vector(s), e.g., a single vector, expressing multiple RNAs or guides under the control or operatively or functionally linked to one or more promoters-especially as to the numbers of RNAs or guides discussed herein, without any undue experimentation.

The guide RNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol IL, pol III, T7, U6, H1, retroviral Rous sarcoma virus (RSV) LTR promoter, the cytomegalovirus (CMV) promoter, the SV40 promoter, the dihydrofolate reductase promoter, the P-actin promoter, the phosphoglycerol kinase (PGK) promoter, and the EF1α promoter. An advantageous promoter is the promoter is U6.

Figure 5:
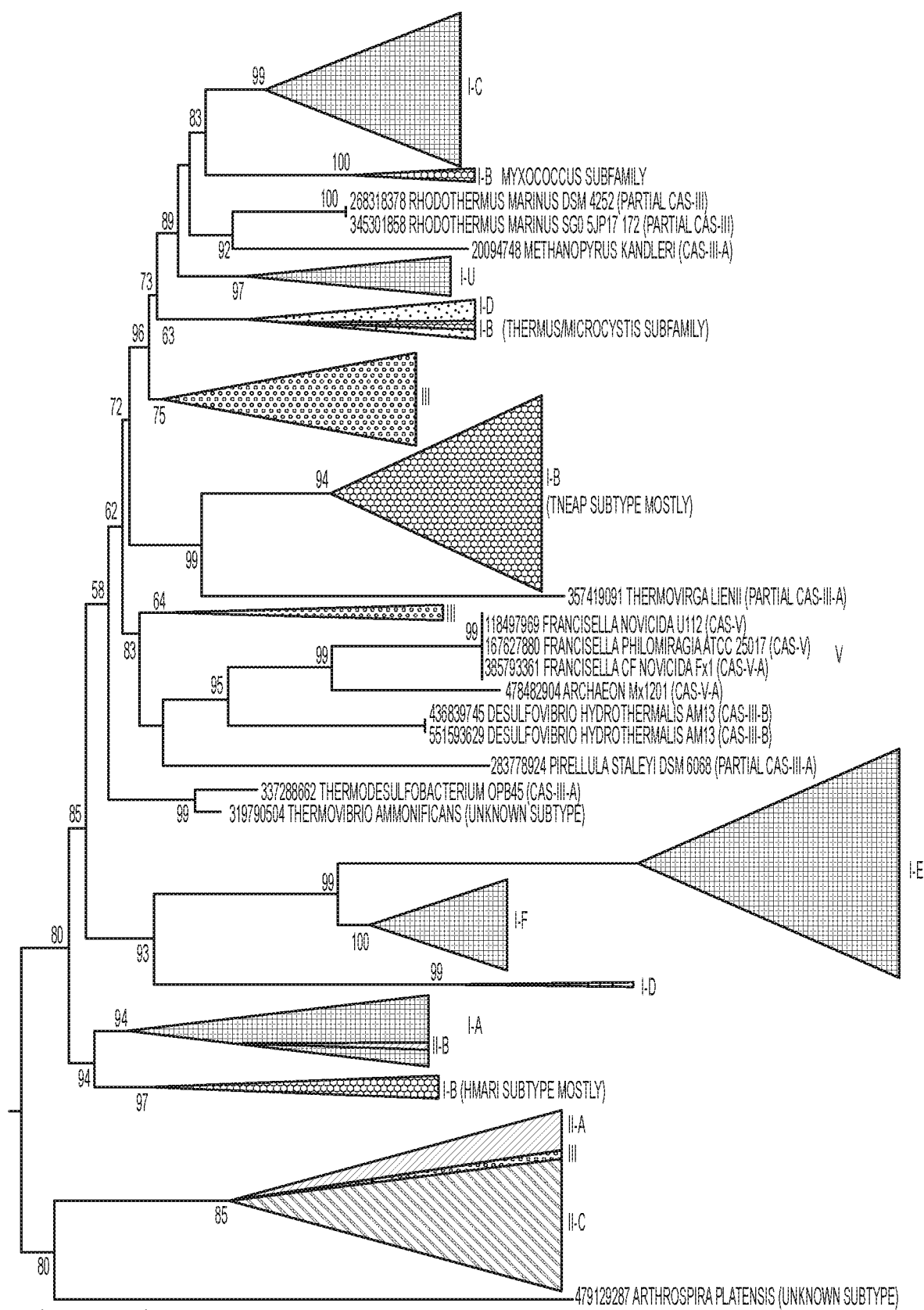
FIG. 5 shows a Cas1 phylogeny where recombination of adaptation and crRNA-effector modules show a major aspect of CRISPR-Cas evolution.
Figure 6:
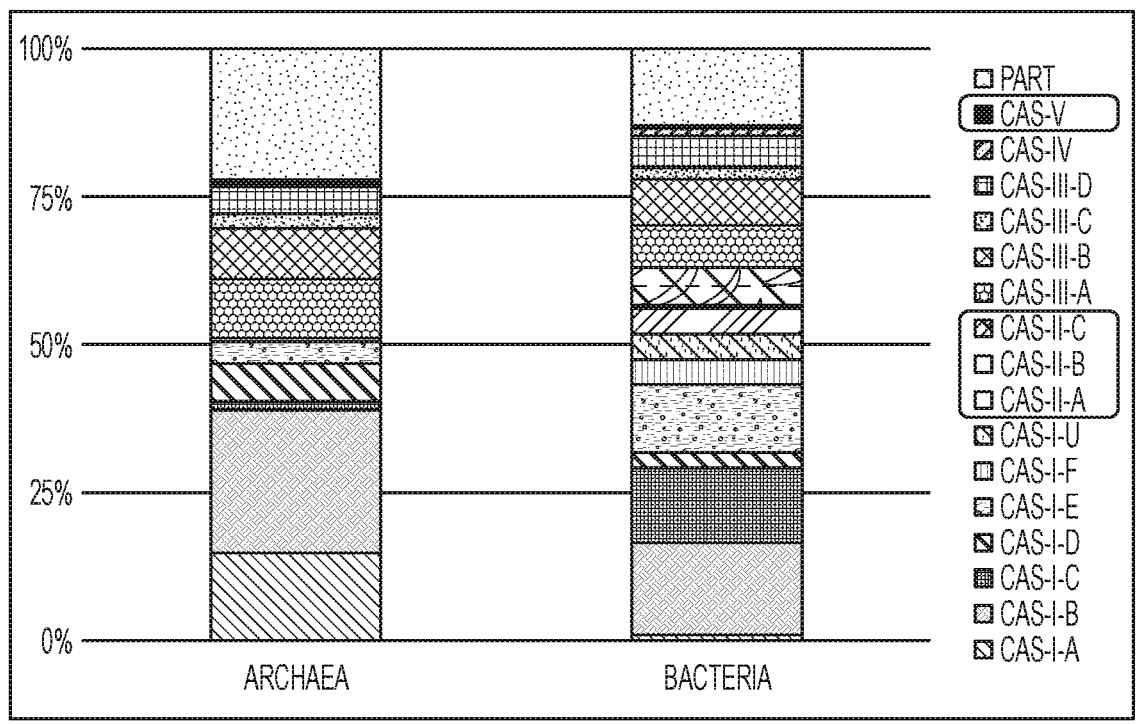
FIG. 6 shows a CRISPR-Cas census, specifically a distribution of CRISPR-Cas types/subtypes among archaea and bacteria.
Figures 1, 113:
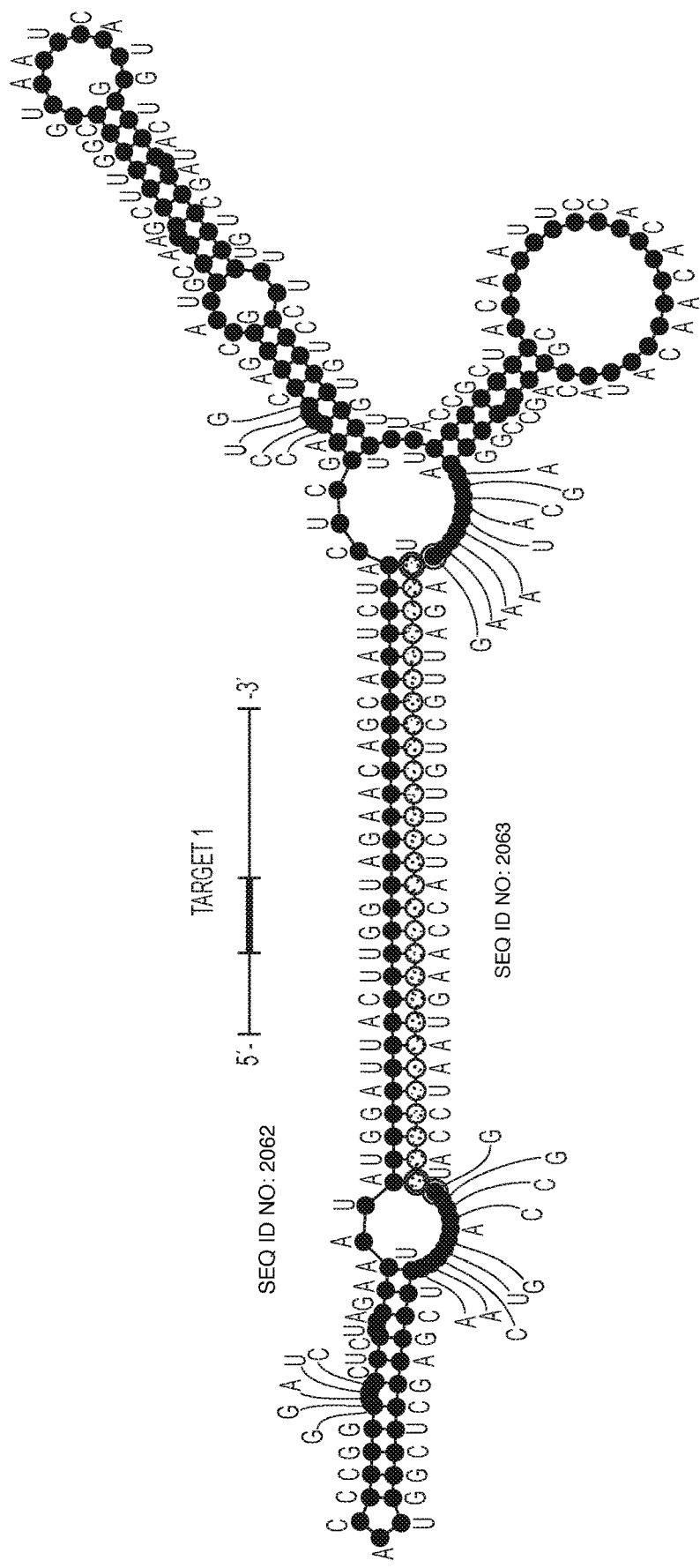
Figures 2, 113:
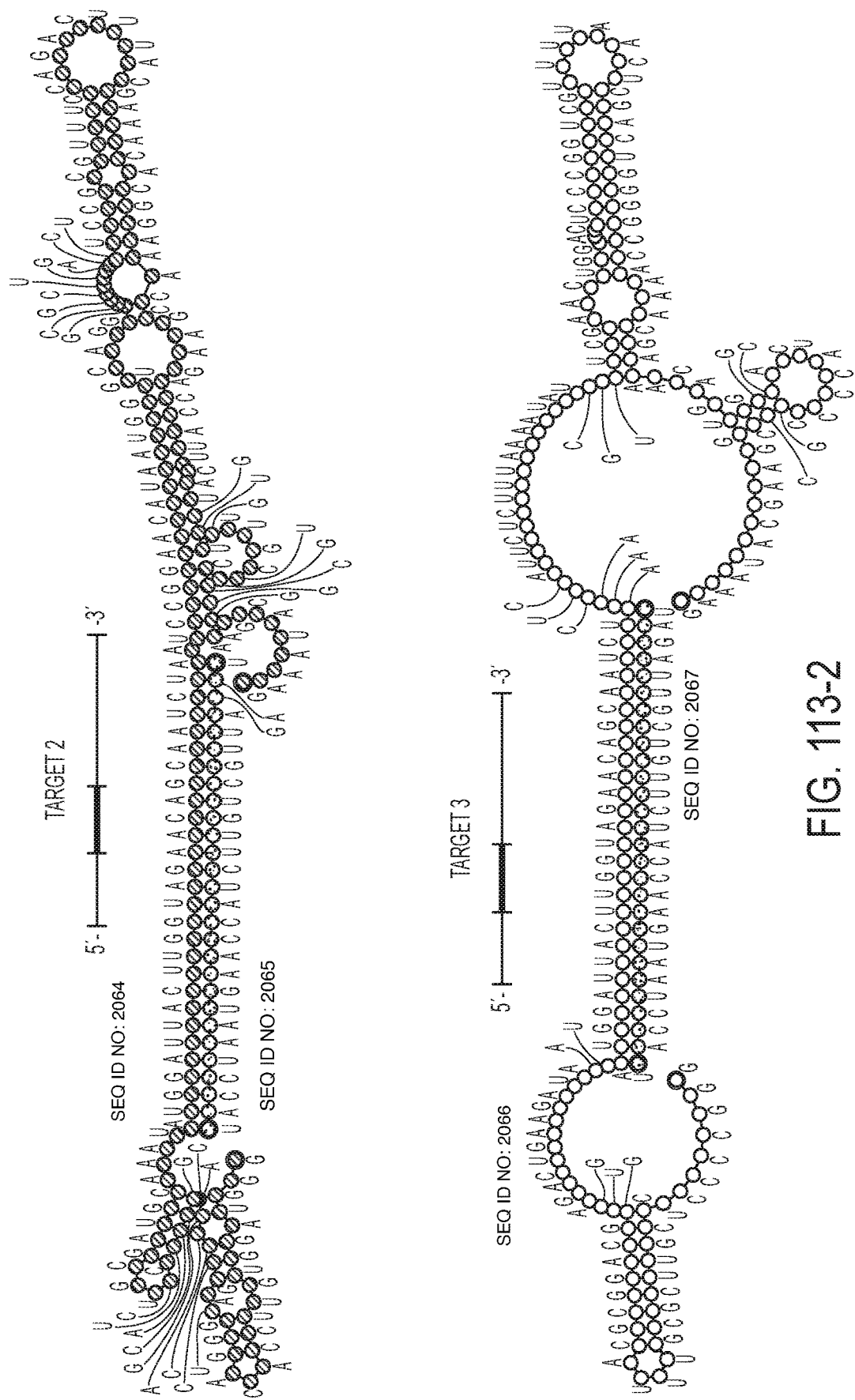
Figures 3, 113:
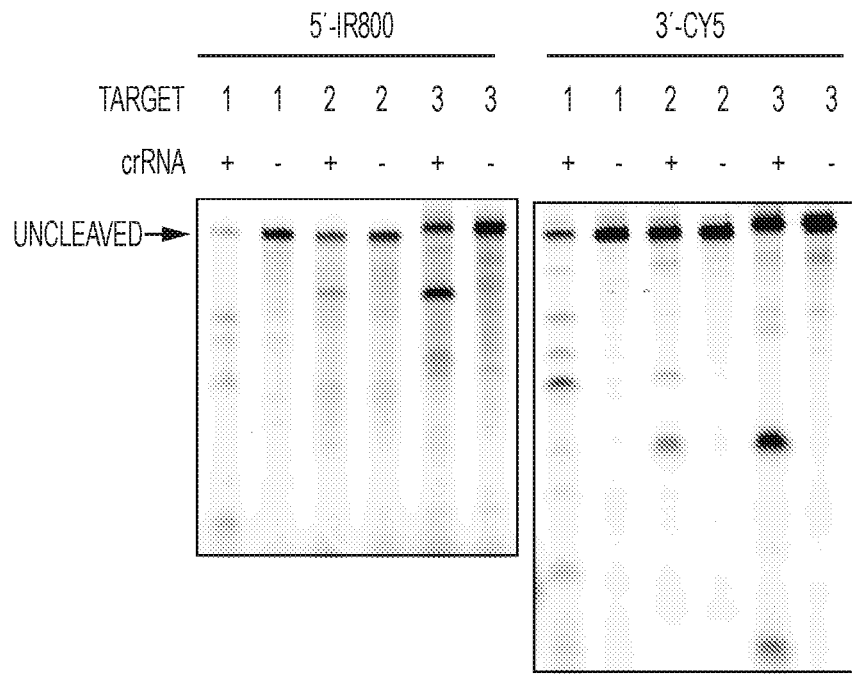
Figure 114A:
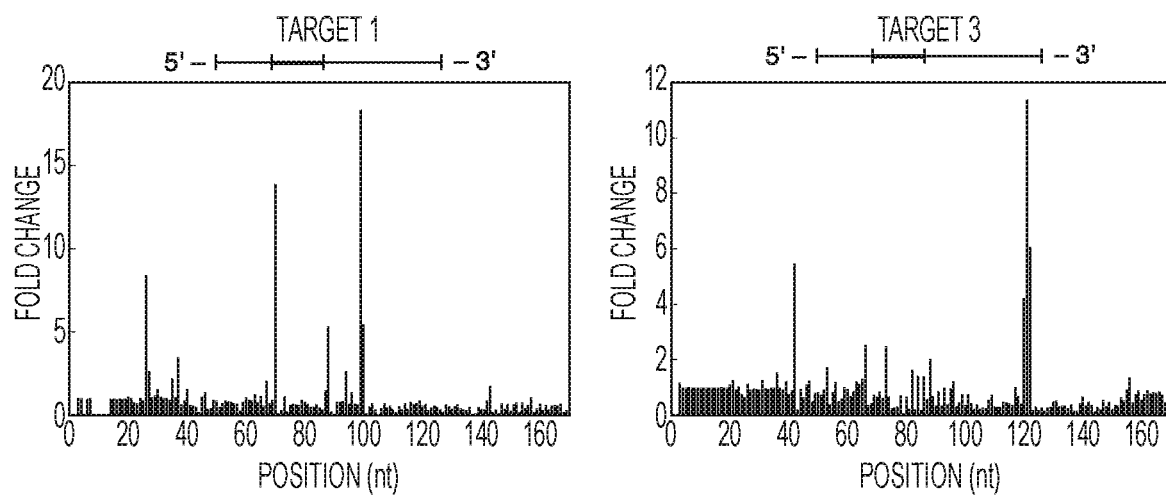
Figures 1, 114B:
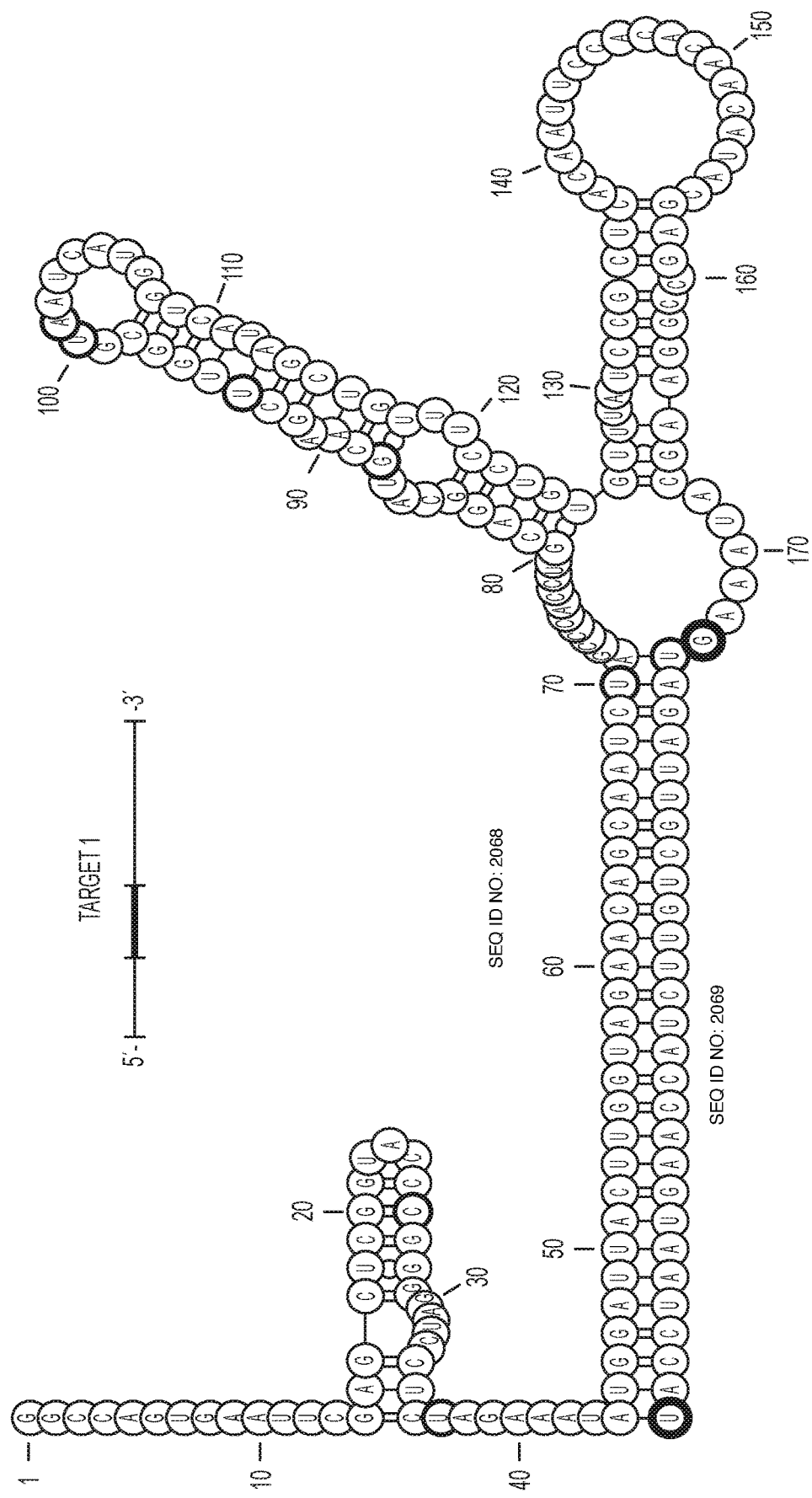
Figures 2, 114B:
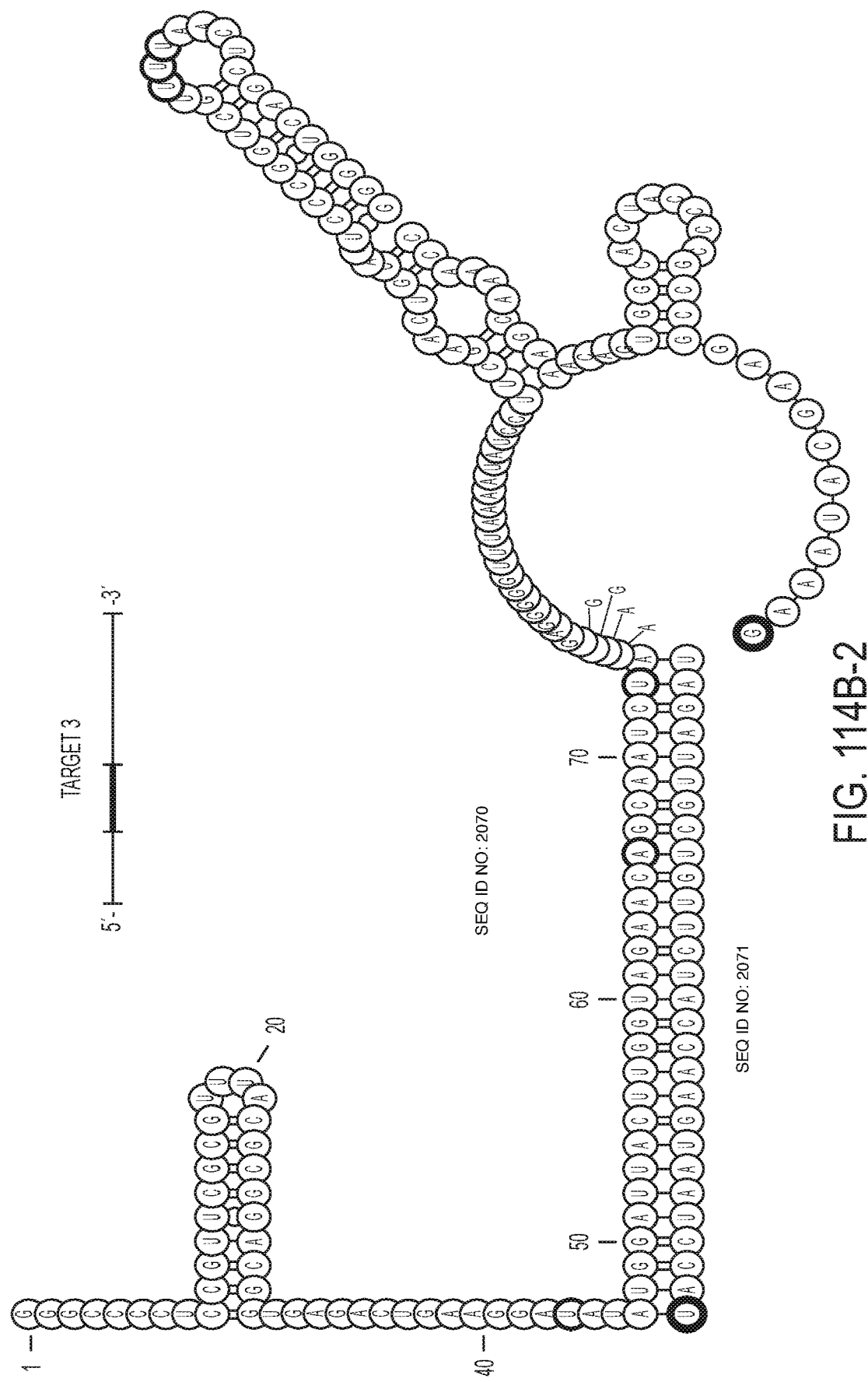
Figure 115A:
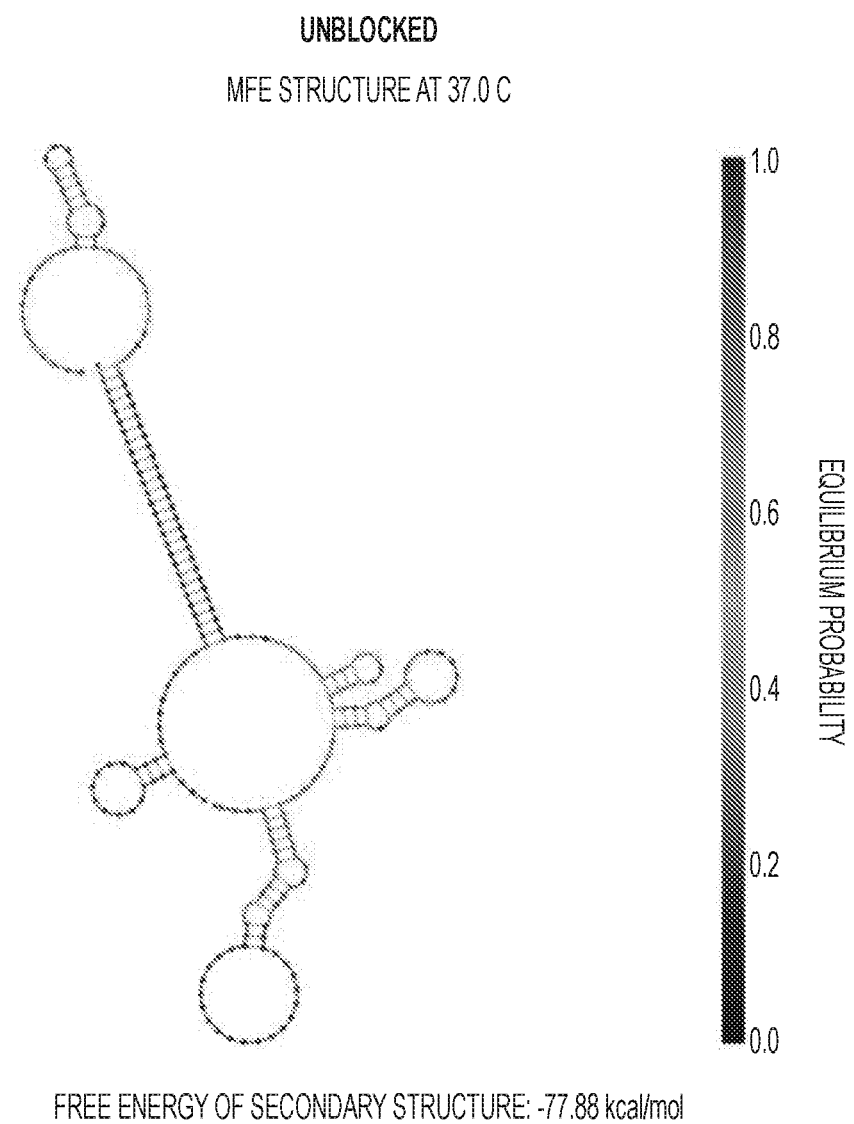
FIG. 115A-115I shows further target environment secondary structures useful for evaluation of C2c2 cleavage efficiency and cleavage site mapping.
Figure 115B:
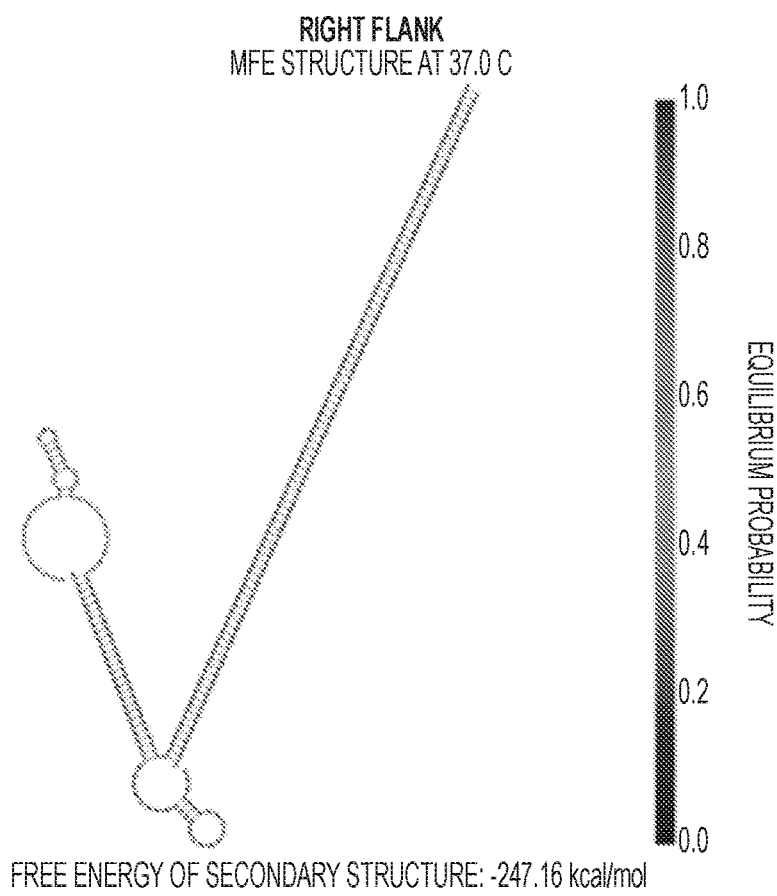
Figure 115C:
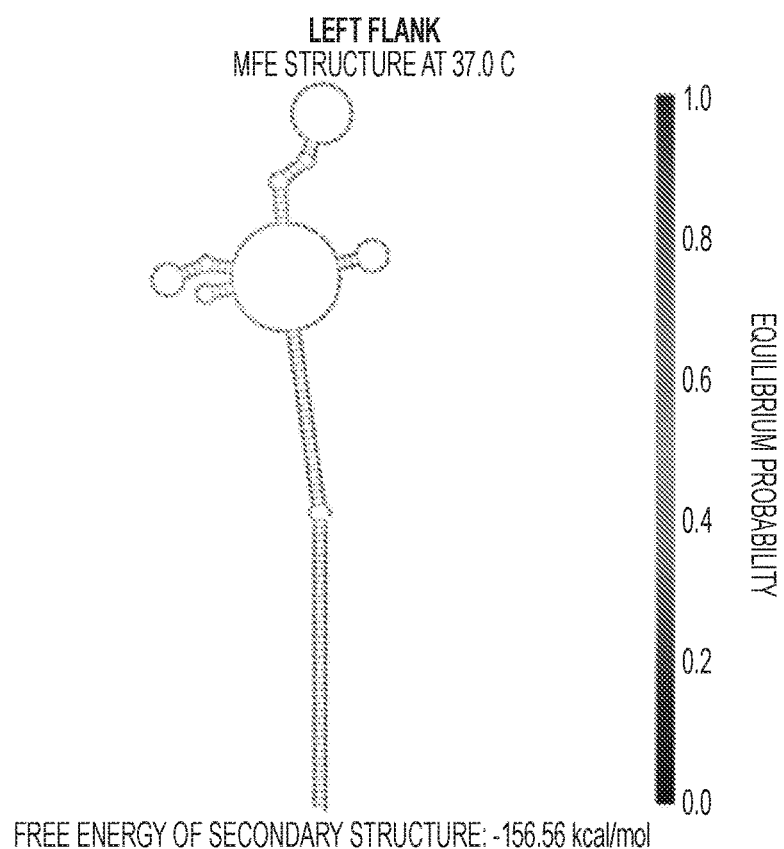
Figure 115D:
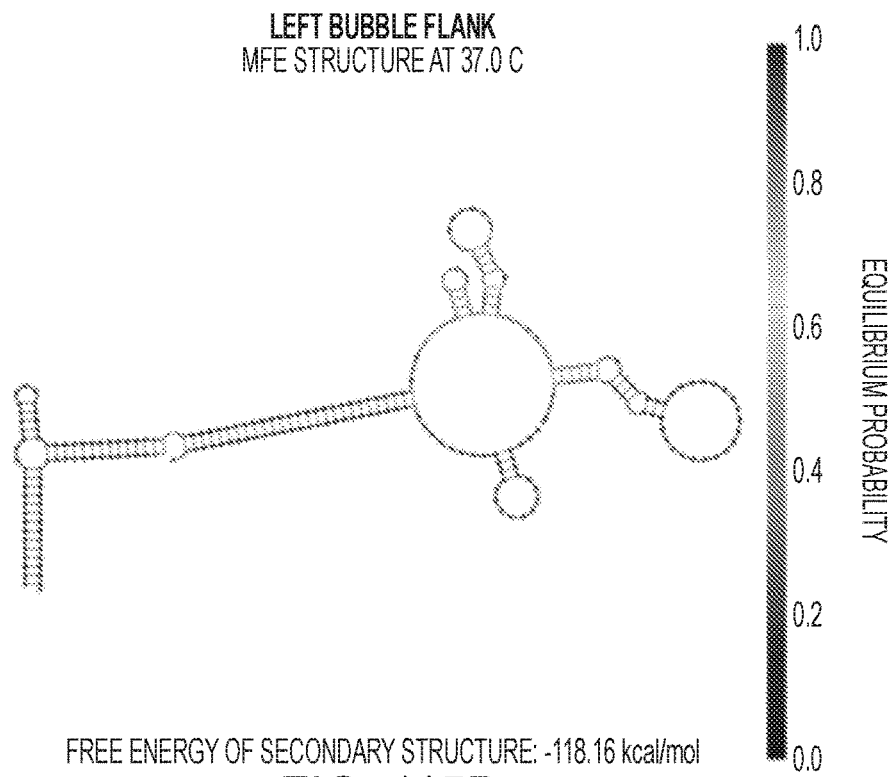
Figure 115E:
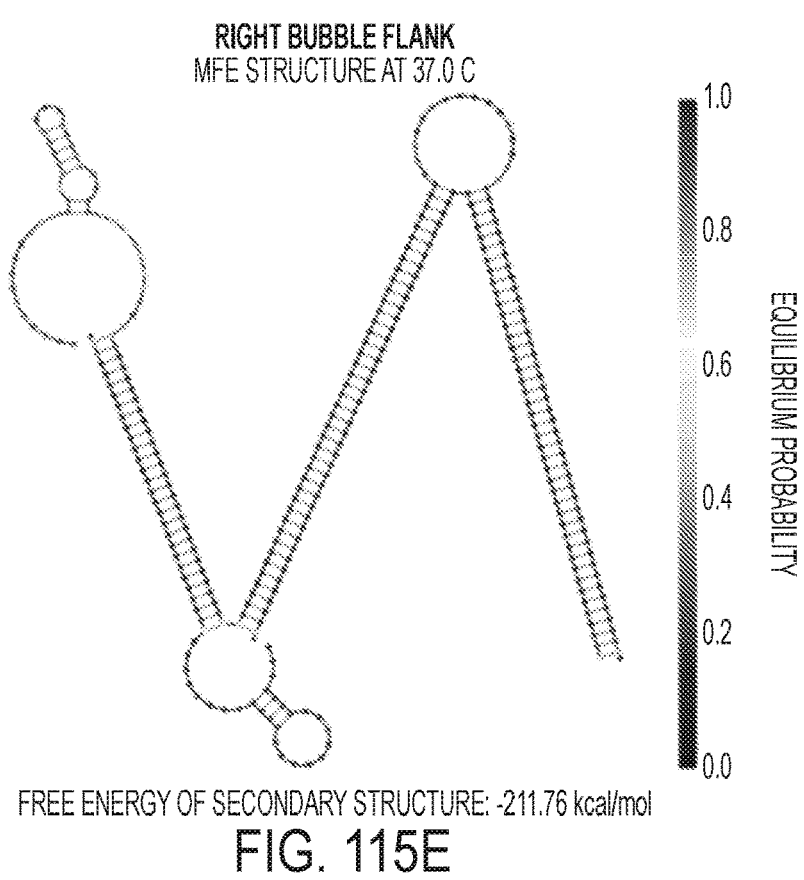
Figure 115F:
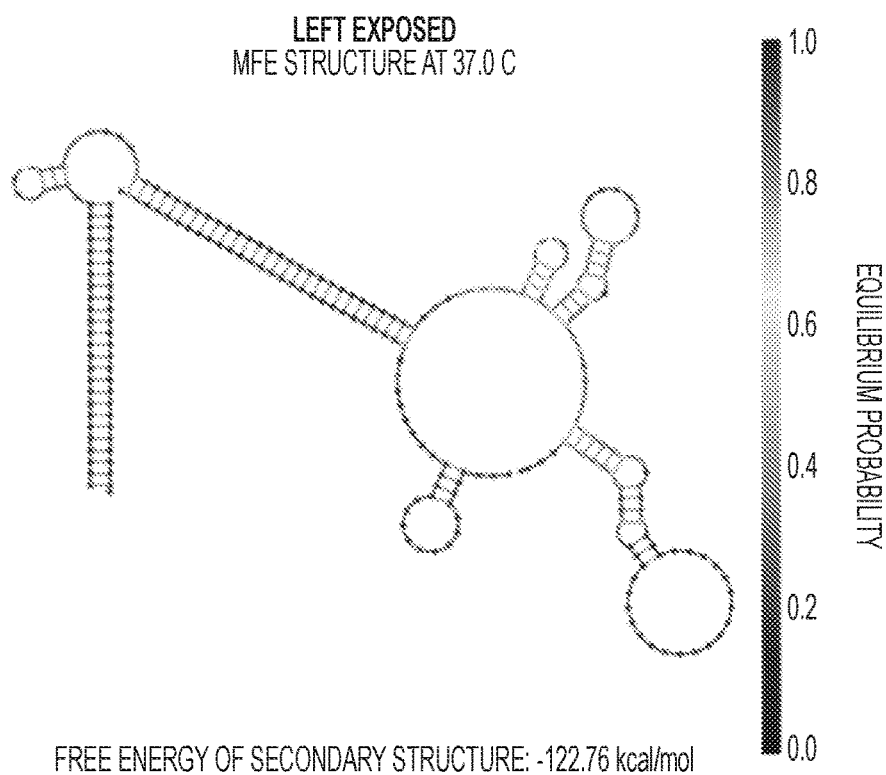
Figure 115G:
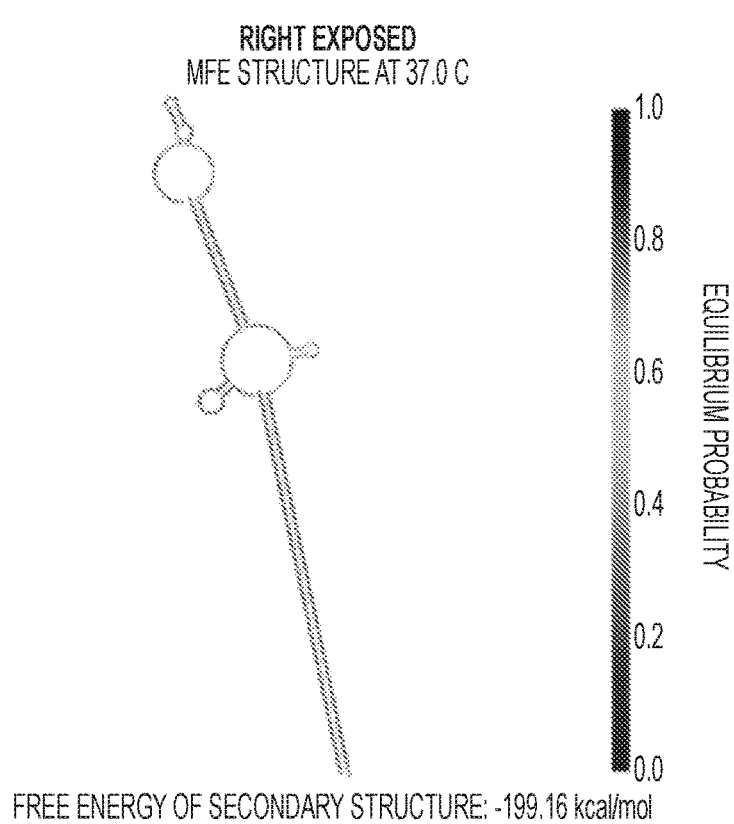
Figure 115H:
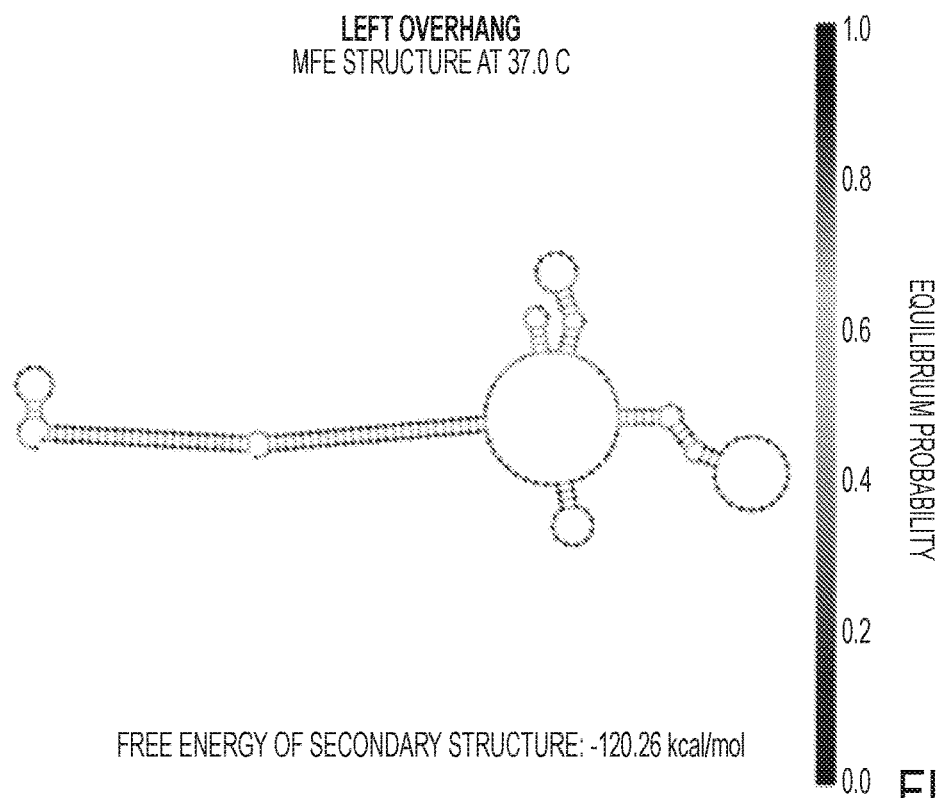
Figure 115I:
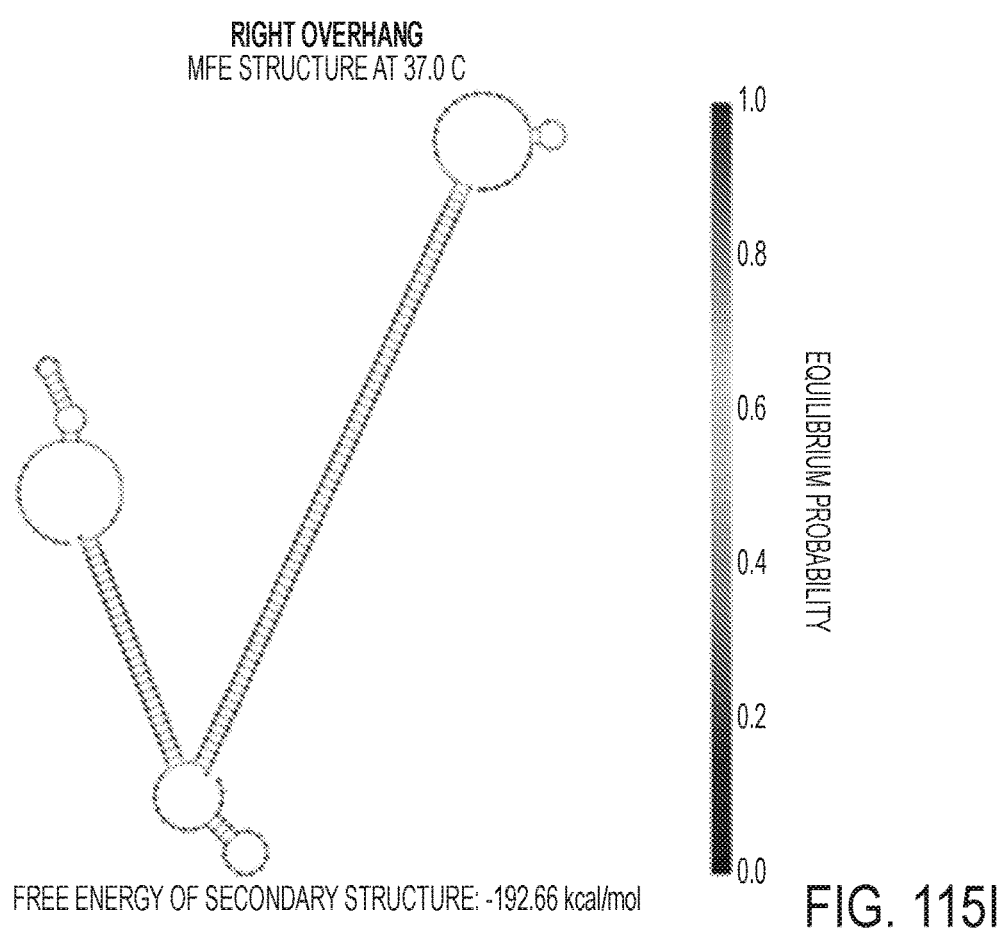

The CRISPR-Cas loci has more than 50 gene families and there is no strictly universal genes. Therefore, no single evolutionary tree is feasible and a multi-pronged approach is needed to identify new families. So far, there is comprehensive cas gene identification of 395 profiles for 93 Cas proteins. Classification includes signature gene profiles plus signatures of locus architecture. A new classification of CRISPR-Cas systems is proposed in FIGS. 1A and 1B. Class 1 includes multisubunit crRNA-effector complexes (Cascade) and Class 2 includes Single-subunit crRNA-effector complexes (Cas9-like). FIG. 2 provides a molecular organization of CRISPR-Cas. FIG. 3 provides structures of Type I and III effector complexes: common architecture/common ancestry despite extensive sequence divergence. FIG. 4 shows CRISPR-Cas as a RNA recognition motif (RRM)-centered system. FIG. 5 shows Cas1 phylogeny where recombination of adaptation and crRNA-effector modules show a major aspect of CRISPR-Cas evolution. FIG. 6 shows a CRISPR-Cas census, specifically a distribution of CRISPR-Cas types/subtypes among archaea and bacteria.

The action of the CRISPR-Cas system is usually divided into three stages: (1) adaptation or spacer integration, (2) processing of the primary transcript of the CRISPR locus (pre-crRNA) and maturation of the crRNA which includes the spacer and variable regions corresponding to 5' and 3' fragments of CRISPR repeats, and (3) DNA or RNA interference. Two proteins, Cas1 and Cas2, that are present in the great majority of the known CRISPR-Cas systems are sufficient for the insertion of spacers into the CRISPR cassettes. These two proteins form a complex that is required for this adaptation process; the endonuclease activity of Cas1 is required for spacer integration whereas Cas2 appears to perform a nonenzymatic function. The Cas1-Cas2 complex represents the highly conserved "information processing" module of CRISPR-Cas that appears to be quasi-autonomous from the rest of the system. (See Annotation and Classification of CRISPR-Cas Systems. Makarova K S, Koonin E V. Methods Mol Biol. 2015; 1311:47-75).

The previously described Class 2 systems, namely Type II and the putative Type V, consisted of only three or four genes in the cas operon, namely the cas1 and cas2 genes comprising the adaptation module (the cas1-cas2 pair of genes are not involved in interference), a single multidomain effector protein that is responsible for interference but also contributes to the pre-crRNA processing and adaptation, and often a fourth gene with uncharacterized functions that is dispensable in at least some Type II systems (and in some cases the fourth gene is cas4 (biochemical or in silico evidence shows that Cas4 is a PD-(DE)×K superfamily nuclease with three-cysteine C-terminal cluster; possesses 5'-ssDNA exonuclease activity) or csn2, which encodes an inactivated ATPase). In most cases, a CRISPR array and a gene for a distinct RNA species known as tracrRNA, a trans-encoded small CRISPR RNA, are adjacent to Class 2 cas operons. The tracrRNA is partially homologous to the repeats within the respective CRISPR array and is essential for the processing of pre-crRNA that is catalyzed by RNAse III, a ubiquitous bacterial enzyme that is not associated with the CRISPR-cas loci.

Cas1 is the most conserved protein that is present in most of the CRISPR-Cas systems and evolves slower than other Cas proteins. Accordingly, Cas1 phylogeny has been used as the guide for CRISPR-Cas system classification. Biochemical or in silico evidence shows that Cas1 is a metal-dependent deoxyribonuclease. Deletion of Cas1 in *E. coli* results in increased sensitivity to DNA damage and impaired chromosomal segregation as described in "A dual function of the CRISPR-Cas system in bacterial antivirus immunity and DNA repair," Babu M et al. Mol Microbiol 79:484-502 (2011). Biochemical or in silico evidence shows that Cas 2 is a RNase specific to U-rich regions and is a double-stranded DNase.

Aspects of the invention relate to the identification and engineering of novel effector proteins associated with Class 2 CRISPR-Cas systems. In a preferred embodiment, the effector protein comprises a single-subunit effector module. In a further embodiment the effector protein is functional in prokaryotic or eukaryotic cells for in vitro, in vivo or ex vivo applications. An aspect of the invention encompasses computational methods and algorithms to predict new Class 2 CRISPR-Cas systems and identify the components therein.

In one embodiment, a computational method of identifying novel Class 2 CRISPR-Cas loci comprises the following steps: detecting all contigs encoding the Cas1 protein; identifying all predicted protein coding genes within 20 kB of the cas1 gene, more particularly within the region 20 kb from the start of the cas1 gene and 20 kb from the end of the cas1 gene; comparing the identified genes with Cas protein-specific profiles and predicting CRISPR arrays; selecting partial and/or unclassified candidate CRISPR-Cas loci containing proteins larger than 500 amino acids (>500 aa); analyzing selected candidates using PSI-BLAST and HHPred, thereby isolating and identifying novel Class 2 CRISPR-Cas loci. In addition to the above-mentioned steps, additional analysis of the candidates may be conducted by searching metagenomics databases for additional homologs.

In one aspect the detecting all contigs encoding the Cas1 protein is performed by GenemarkS which a gene prediction program as further described in "GeneMarkS: a self-training method for prediction of gene starts in microbial genomes. Implications for finding sequence motifs in regulatory regions." John Besemer, Alexandre Lomsadze and Mark Borodovsky, Nucleic Acids Research (2001) 29, pp 2607-2618, herein incorporated by reference.

In one aspect the identifying all predicted protein coding genes is carried out by comparing the identified genes with Cas protein-specific profiles and annotating them according to NCBI Conserved Domain Database (CDD) which is a protein annotation resource that consists of a collection of well-annotated multiple sequence alignment models for ancient domains and full-length proteins. These are available as position-specific score matrices (PSSMs) for fast identification of conserved domains in protein sequences via RPS-BLAST. CDD content includes NCBI-curated domains, which use 3D-structure information to explicitly define domain boundaries and provide insights into sequence/structure/function relationships, as well as domain models imported from a number of external source databases (Pfam, SMART, COG, PRK, TIGRFAM). In a further aspect, CRISPR arrays were predicted using a PILER-CR program which is a public domain software for finding CRISPR repeats as described in "PILER-CR: fast and accurate identification of CRISPR repeats", Edgar, R. C., BMC Bioinformatics, January 20; 8:18 (2007), herein incorporated by reference.

In a further aspect, the case-by-case analysis is performed using PSI-BLAST (Position-Specific Iterative Basic Local Alignment Search Tool). PSI-BLAST derives a position-specific scoring matrix (PSSM) or profile from the multiple sequence alignment of sequences detected above a given score threshold using protein-protein BLAST. This PSSM is used to further search the database for new matches, and is updated for subsequent iterations with these newly detected sequences. Thus, PSI-BLAST provides a means of detecting distant relationships between proteins.

In another aspect, the case-by-case analysis is performed using HHpred, a method for sequence database searching and structure prediction that is as easy to use as BLAST or PSI-BLAST and that is at the same time much more sensitive in finding remote homologs. In fact, HHpred's sensitivity is competitive with the most powerful servers for structure prediction currently available. HHpred is the first server that is based on the pairwise comparison of profile hidden Markov models (HMMs). Whereas most conventional sequence search methods search sequence databases such as UniProt or the NR, HHpred searches alignment databases, like Pfam or SMART. This greatly simplifies the list of hits to a number of sequence families instead of a clutter of single sequences. All major publicly available profile and alignment databases are available through HHpred. HHpred accepts a single query sequence or a multiple alignment as input. Within only a few minutes it returns the search results in an easy-to-read format similar to that of PSI-BLAST. Search options include local or global alignment and scoring secondary structure similarity. HHpred can produce pairwise query-template sequence alignments, merged query-template multiple alignments (e.g. for transitive searches), as well as 3D structural models calculated by the MODELLER software from HHpred alignments.

The term "nucleic acid-targeting system", wherein nucleic acid is DNA or RNA, and in some aspects may also refer to DNA-RNA hybrids or derivatives thereof, refers collectively to transcripts and other elements involved in the expression of or directing the activity of DNA or RNA-targeting CRISPR-associated ("Cas") genes, which may include sequences encoding a DNA or RNA-targeting Cas protein and a DNA or RNA-targeting guide RNA comprising a CRISPR RNA (crRNA) sequence and (in some but not all systems) a trans-activating CRISPR/Cas system RNA (tracrRNA) sequence, or other sequences and transcripts from a DNA or RNA-targeting CRISPR locus. In general, a RNA-targeting system is characterized by elements that promote the formation of a DNA or RNA-targeting complex at the site of a target DNA or RNA sequence. In the context of formation of a DNA or RNA-targeting complex, "target sequence" refers to a DNA or RNA sequence to which a DNA or RNA-targeting guide RNA is designed to have complementarity, where hybridization between a target sequence and a RNA-targeting guide RNA promotes the formation of a RNA-targeting complex. In some embodiments, a target sequence is located in the nucleus or cytoplasm of a cell.

In an aspect of the invention, novel RNA targeting systems also referred to as RNA- or RNA-targeting CRISPR/Cas or the CRISPR-Cas system RNA-targeting system of the present application are based on identified Type VI Cas proteins which do not require the generation of customized proteins to target specific RNA sequences but rather a single enzyme can be programmed by a RNA molecule to recognize a specific RNA target, in other words the enzyme can be recruited to a specific RNA target using said RNA molecule.

In an aspect of the invention, novel DNA targeting systems also referred to as DNA- or DNA-targeting CRISPR/Cas or the CRISPR-Cas system RNA-targeting system of the present application are based on identified Type VI Cas proteins which do not require the generation of customized proteins to target specific RNA sequences but rather a single enzyme can be programmed by a RNA molecule to recognize a specific DNA target, in other words the enzyme can be recruited to a specific DNA target using said RNA molecule.

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing; trafficking of target nucleic acids, tracing of target nucleic acids, isolation of target nucleic acids, visualization of target nucleic acids, etc.

As used herein, a Cas protein or a CRISPR enzyme refers to any of the proteins presented in the new classification of CRISPR-Cas systems.

In an advantageous embodiment, the present invention encompasses effector proteins identified in a Type VI CRISPR-Cas loci, e.g. the C2c2 loci. Herein, C2c2 refers to Class 2 candidate 2. The C2c2 loci encompass cas1 and cas2 genes along with the large protein Applicants denote as C2c2p, and a CRISPR array; however, C2c2p is often encoded next to a CRISPR array but not cas1-cas2 (compare FIG. 9 and FIG. 15). C2c2 Nuclease The activity of C2c2 depends on the presence of two HEPN domains. These have been shown to be RNase domains, i.e., nuclease (in particular an endonuclease) cutting RNA. C2c2 HEPN may also target DNA, or potentially DNA and/or RNA. On the basis that that the HEPN domains of C2c2 are at least capable of binding to and, in their wild-type form, cutting RNA, then it is preferred that the C2c2 effector protein has RNase function. It may also, or alternatively, have DNase function.

Thus, in some embodiments, the effector protein may be a RNA-binding protein, such as a dead-Cas type effector protein, which may be optionally functionalized as described herein for instance with an transcriptional activator or repressor domain, NLS or other functional domain. In some embodiments, the effector protein may be a RNA-binding protein that cleaves a single strand of RNA. If the RNA bound is ssRNA, then the ssRNA is fully cleaved. In some embodiments, the effector protein may be a RNA-binding protein that cleaves a double strand of RNA, for example if it comprises two RNase domains. If the RNA bound is dsRNA, then the dsRNA is fully cleaved.

RNase function in CRISPR systems is known, for example mRNA targeting has been reported for certain type III CRISPR-Cas systems (Hale et al., 2014, Genes Dev, vol. 28, 2432-2443; Hale et al., 2009, Cell, vol. 139, 945-956; Peng et al., 2015, Nucleic acids research, vol. 43, 406-417) and provides significant advantages. In the *Staphylococcus epidermis* type III-A system, transcription across targets results in cleavage of the target DNA and its transcripts, mediated by independent active sites within the Cas10-Csm ribonucleoprotein effector complex (see, Samai et al., 2015, Cell, vol. 151, 1164-1174). A CRISPR-Cas system, composition or method targeting RNA via the present effector proteins is thus provided.

The target RNA, i.e. the RNA of interest, is the RNA to be targeted by the present invention leading to the recruitment to, and the binding of the effector protein at, the target site of interest on the target RNA. The target RNA may be any suitable form of RNA. This may include, in some embodiments, mRNA. In other embodiments, the target RNA may include tRNA or rRNA. In other embodiments, the target RNA may include miRNA. In other embodiments, the target RNA may include siRNA.

Interfering RNA (RNAi) and microRNA (miRNA)

In other embodiments, the target RNA may include interfering RNA, i.e. RNA involved in an RNA interference pathway, such as shRNA, siRNA and so forth. In other embodiments, the target RNA may include microRNA (miRNA). Control over interfering RNA or miRNA may help reduce off-target effects (OTE) seen with those approaches by reducing the longevity of the interfering RNA or miRNA in vivo or in vitro.

In certain embodiments, the target is not the miRNA itself, but the miRNA binding site of a miRNA target.

In certain embodiments, miRNAs may be sequestered (such as including subcellularly relocated). In certain embodiments, miRNAs may be cut, such as without limitation at hairpins.

In certain embodiments, miRNA processing (such as including turnover) is increased or decreased.

If the effector protein and suitable guide are selectively expressed (for example spatially or temporally under the control of a suitable promoter, for example a tissue- or cell cycle-specific promoter and/or enhancer) then this could be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The effector protein may be used to control or bind to molecules comprising or consisting of RNA, such as ribozymes, ribosomes or riboswitches. In embodiments of the invention, the RNA guide can recruit the effector protein to these molecules so that the effector protein is able to bind to them.

The protein system of the invention can be applied in areas of RNAi technologies, without undue experimentation, from this disclosure, including therapeutic, assay and other applications (see, e.g., Guidi et al., PLoS Negl Trop Dis 9(5): e0003801. doi:10.1371/journal.pntd; Crotty et al., In vivo RNAi screens: concepts and applications. Shane Crotty 2015 Elsevier Ltd. Published by Elsevier Inc., Pesticide Biochemistry and Physiology (Impact Factor: 2.01). 01/2015; 120. DOI: 10.1016j.pestbp.2015.01.002 and Makkonen et al., Viruses 2015, 7(4), 2099-2125; doi: 10.3390/v7042099), because the present application provides the foundation for informed engineering of the system.

Ribosomal RNA (rRNA)

For example, azalide antibiotics such as azithromycin, are well known. They target and disrupt the 50S ribosomal subunit. The present effector protein, together with a suitable guide RNA to target the 50S ribosomal subunit, may be, in some embodiments, recruited to and bind to the 50S ribosomal subunit. Thus, the present effector protein in concert with a suitable guide directed at a ribosomal (especially the 50s ribosomal subunit) target is provided. Use of this use effector protein in concert with the suitable guide directed at the ribosomal (especially the 50s ribosomal subunit) target may include antibiotic use. In particular, the antibiotic use is analogous to the action of azalide antibiotics, such as azithromycin. In some embodiments, prokaryotic ribosomal subunits, such as the 70S subunit in prokaryotes, the 50S subunit mentioned above, the 30S subunit, as well as the 16S and 5S subunits may be targeted. In other embodiments, eukaryotic ribosomal subunits, such as the 80S subunit in eukaryotes, the 60S subunit, the 40S subunit, as well as the 28S, 18S. 5.8S and 5S subunits may be targeted.

In some embodiments, the effector protein may be a RNA-binding protein, optionally functionalized, as described herein. In some embodiments, the effector protein may be a RNA-binding protein that cleaves a single strand of RNA. In either case, but particularly where the RNA-binding protein cleaves a single strand of RNA, then ribosomal function may be modulated and, in particular, reduced or destroyed. This may apply to any ribosomal RNA and any ribosomal subunit and the sequences of rRNA are well known.

Control of ribosomal activity is thus envisaged through use of the present effector protein in concert with a suitable guide to the ribosomal target. This may be through cleavage of, or binding to, the ribosome. In particular, reduction of ribosomal activity is envisaged. This may be useful in assaying ribosomal function in vivo or in vitro, but also as a means of controlling therapies based on ribosomal activity, in vivo or in vitro. Furthermore, control (i.e. reduction) of protein synthesis in an in vivo or in vitro system is envisaged, such control including antibiotic and research and diagnostic use.

Riboswitches

A riboswitch (also known as an aptozyme) is a regulatory segment of a messenger RNA molecule that binds a small molecule. This typically results in a change in production of the proteins encoded by the mRNA. Thus, control of riboswitch activity is thus envisaged through use of the present effector protein in concert with a suitable guide to the riboswitch target. This may be through cleavage of, or binding to, the riboswitch. In particular, reduction of riboswitch activity is envisaged. This may be useful in assaying riboswitch function in vivo or in vitro, but also as a means of controlling therapies based on riboswitch activity, in vivo or in vitro. Furthermore, control (i.e. reduction) of protein synthesis in an in vivo or in vitro system is envisaged. This control, as for rRNA may include antibiotic and research and diagnostic use.

Ribozymes

Ribozymes are RNA molecules having catalytic properties, analogous to enzymes (which are proteins). As ribozymes, both naturally occurring and engineered, comprise or consist of RNA, they may also be targeted by the present RNA-binding effector protein. In some embodiments, the effector protein may be a RNA-binding protein cleaves the ribozyme to thereby disable it. Control of ribozymal activity is thus envisaged through use of the present effector protein in concert with a suitable guide to the ribozymal target. This may be through cleavage of, or binding to, the ribozyme. In particular, reduction of ribozymal activity is envisaged. This may be useful in assaying ribozymal function in vivo or in vitro, but also as a means of controlling therapies based on ribozymal activity, in vivo or in vitro.

Gene Expression, Including RNA Processing

The effector protein may also be used, together with a suitable guide, to target gene expression, including via control of RNA processing. The control of RNA processing may include RNA processing reactions such as RNA splicing, including alternative splicing, via targeting of RNApol; viral replication (in particular of satellite viruses, bacteriophages and retroviruses, such as HBV, HBC and HIV and others listed herein) including virioids in plants; and tRNA biosynthesis. The effector protein and suitable guide may also be used to control RNA activation (RNAa). RNAa leads to the promotion of gene expression, so control of gene expression may be achieved that way through disruption or reduction of RNAa and thus less promotion of gene expression. This is discussed more in detail below.

RNAi Screens

Identifying gene products whose knockdown is associated with phenotypic changes, biological pathways can be interrogated and the constituent parts identified, via RNAi screens. Control may also be exerted over or during these screens by use of the effector protein and suitable guide to remove or reduce the activity of the RNAi in the screen and thus reinstate the activity of the (previously interfered with) gene product (by removing or reducing the interference/repression).

Satellite RNAs (satRNAs) and satellite viruses may also be treated.

Control herein with reference to RNase activity generally means reduction, negative disruption or known-down or knock out.

In Vivo RNA Applications

Inhibition of Gene Expression

The target-specific RNAses provided herein allow for very specific cutting of a target RNA. The interference at RNA level allows for modulation both spatially and temporally and in a non-invasive way, as the genome is not modified.

A number of diseases have been demonstrated to be treatable by mRNA targeting. While most of these studies relate to administration of siRNA, it is clear that the RNA targeting effector proteins provided herein can be applied in a similar way.

Examples of mRNA targets (and corresponding disease treatments) are VEGF, VEGF-R1 and RTP801 (in the treatment of AMD and/or DME), Caspase 2 (in the treatment of Naion)ADRB2 (in the treatment of intraocular pressure), TRPVI (in the treatment of Dry eye syndrome, Syk kinase (in the treatment of asthma), Apo B (in the treatment of hypercholesterolemia), PLK1, KSP and VEGF (in the treatment of solid tumors), Ber-Abl (in the treatment of CMLX-Burnett and Rossi Chem Biol. 2012, 19(1): 60-71)). Similarly, RNA targeting has been demonstrated to be effective in the treatment of RNA-virus mediated diseases such as HIV (targeting of HIV Tet and Rev), RSV (targeting of RSV nucleocapsid) and HCV (targeting of miR-122) (Burnett and Rossi Chem Biol. 2012, 19(1): 60-71).

It is further envisaged that the RNA targeting effector protein of the invention can be used for mutation specific or allele specific knockdown. Guide RNA's can be designed that specifically target a sequence in the transcribed mRNA comprising a mutation or an allele-specific sequence. Such specific knockdown is particularly suitable for therapeutic applications relating to disorders associated with mutated or allele-specific gene products. For example, most cases of familial hypobetalipoproteinemia (FHBL) are caused by mutations in the ApoB gene. This gene encodes two versions of the apolipoprotein B protein: a short version (ApoB-48) and a longer version (ApoB-100). Several ApoB gene mutations that lead to FHBL cause both versions of ApoB to be abnormally short. Specifically targeting and knockdown of mutated ApoB mRNA transcripts with an RNA targeting effector protein of the invention may be beneficial in treatment of FHBL. As another example, Huntington's disease (HD) is caused by an expansion of CAG triplet repeats in the gene coding for the Huntingtin protein, which results in an abnormal protein. Specifically targeting and knockdown of mutated or allele-specific mRNA transcripts encoding the Huntingtin protein with an RNA targeting effector protein of the invention may be beneficial in treatment of HD.

It is noted that in this context, and more generally for the various applications as described herein, the use of a split version of the RNA targeting effector protein can be envisaged. Indeed, this may not only allow increased specificity but may also be advantageous for delivery. The C2c2 is split in the sense that the two parts of the C2c2 enzyme substantially comprise a functioning C2c2. Ideally, the split should always be so that the catalytic domain(s) are unaffected. That C2c2 may function as a nuclease or it may be a dead-C2c2 which is essentially an RNA-binding protein with very little or no catalytic activity, due to typically mutation(s) in its catalytic domains.

Each half of the split C2c2 may be fused to a dimerization partner. By means of example, and without limitation, employing rapamycin sensitive dimerization domains, allows to generate a chemically inducible split C2c2 for temporal control of C2c2 activity. C2c2 can thus be rendered chemically inducible by being split into two fragments and that rapamycin-sensitive dimerization domains may be used for controlled reassembly of the C2c2. The two parts of the split C2c2 can be thought of as the N' terminal part and the C' terminal part of the split C2c2. The fusion is typically at the split point of the C2c2. In other words, the C' terminal of the N' terminal part of the split C2c2 is fused to one of the dimer halves, whilst the N' terminal of the C' terminal part is fused to the other dimer half.

The C2c2 does not have to be split in the sense that the break is newly created. The split point is typically designed in silico and cloned into the constructs. Together, the two parts of the split C2c2, the N' terminal and C' terminal parts, form a full C2c2, comprising preferably at least 70% or more of the wildtype amino acids (or nucleotides encoding them), preferably at least 80% or more, preferably at least 90% or more, preferably at least 95% or more, and most preferably at least 99% or more of the wildtype amino acids (or nucleotides encoding them). Some trimming may be possible, and mutants are envisaged. Non-functional domains may be removed entirely. What is important is that the two parts may be brought together and that the desired C2c2 function is restored or reconstituted. The dimer may be a homodimer or a heterodimer.

In certain embodiments, the C2c2 effector as described herein may be used for mutation-specific, or allele-specific targeting, such as for mutation-specific, or allele-specific knockdown.

The RNA targeting effector protein can moreover be fused to another functional RNAse domain, such as a non-specific RNase or Argonaute 2, which acts in synergy to increase the RNAse activity or to ensure further degradation of the message.

Modulation of Gene Expression Through Modulation of RNA Function

Apart from a direct effect on gene expression through cleavage of the mRNA, RNA targeting can also be used to impact specific aspects of the RNA processing within the cell, which may allow a more subtle modulation of gene expression. Generally, modulation can for instance be mediated by interfering with binding of proteins to the RNA, such as for instance blocking binding of proteins, or recruiting RNA binding proteins. Indeed, modulations can be ensured at different levels such as splicing, transport, localization, translation and turnover of the mRNA. Similarly in the context of therapy, it can be envisaged to address (pathogenic) malfunctioning at each of these levels by using RNA-specific targeting molecules. In these embodiments it is in many cases preferred that the RNA targeting protein is a "dead" C2c2 that has lost the ability to cut the RNA target but maintains its ability to bind thereto, such as the mutated forms of c2c2 described herein.

a) Alternative Splicing

Many of the human genes express multiple mRNAs as a result of alternative splicing. Different diseases have been shown to be linked to aberrant splicing leading to loss of function or gain of function of the expressed gene. While some of these diseases are caused by mutations that cause splicing defects, a number of these are not. One therapeutic option is to target the splicing mechanism directly. The RNA targeting effector proteins described herein can for instance be used to block or promote slicing, include or exclude exons and influence the expression of specific isoforms and/or stimulate the expression of alternative protein products. Such applications are described in more detail below.

A RNA targeting effector protein binding to a target RNA can sterically block access of splicing factors to the RNA sequence. The RNA targeting effector protein targeted to a splice site may block splicing at the site, optionally redirecting splicing to an adjacent site. For instance a RNA targeting effector protein binding to the 5' splice site binding can block the recruitment of the U1 component of the spliceosome, favoring the skipping of that exon. Alternatively, a RNA targeting effector protein targeted to a splicing enhancer or silencer can prevent binding of transacting regulatory splicing factors at the target site and effectively block or promote splicing. Exon exclusion can further be achieved by recruitment of ILF2/3 to precursor mRNA near an exon by an RNA targeting effector protein as described herein. As yet another example, a glycine rich domain can be attached for recruitment of hnRNP A1 and exon exclusion (Del Gatto-Konczak et al. Mol Cell Biol. 1999 January; 19(1):251-60).

In certain embodiments, through appropriate selection of gRNA, specific splice variants may be targeted, while other splice variants will not be targeted In some cases the RNA targeting effector protein can be used to promote slicing (e.g. where splicing is defective). For instance a RNA targeting effector protein can be associated with an effector capable of stabilizing a splicing regulatory stem-loop in order to further splicing. The RNA targeting effector protein can be linked to a consensus binding site sequence for a specific splicing factor in order to recruit the protein to the target DNA.

Examples of diseases which have been associated with aberrant splicing include, but are not limited to Paraneoplastic Opsoclonus Myoclonus Ataxia (or POMA), resulting from a loss of Nova proteins which regulate splicing of proteins that function in the synapse, and Cystic Fibrosis, which is caused by defective splicing of a cystic fibrosis transmembrane conductance regulator, resulting in the production of nonfunctional chloride channels. In other diseases aberrant RNA splicing results in gain-of-function. This is the case for instance in myotonic dystrophy which is caused by a CUG triplet-repeat expansion (from 50 to >1500 repeats) in the 3'UTR of an mRNA, causing splicing defects.

The RNA targeting effector protein can be used to include an exon by recruiting a splicing factor (such as U1) to a 5'splicing site to promote excision of introns around a desired exon. Such recruitment could be mediated trough a fusion with an arginine/serine rich domain, which functions as splicing activator (Gravely B R and Maniatis T, Mol Cell. 1998 (5):765-71).

It is envisaged that the RNA targeting effector protein can be used to block the splicing machinery at a desired locus, resulting in preventing exon recognition and the expression of a different protein product. An example of a disorder that may treated is Duchenne muscular dystrophy (DMD), which is caused by mutations in the gene encoding for the dystrophin protein. Almost all DMD mutations lead to frameshifts, resulting in impaired dystrophin translation. The RNA targeting effector protein can be paired with splice junctions or exonic splicing enhancers (ESEs) thereby preventing exon recognition, resulting in the translation of a partially functional protein. This converts the lethal Duchenne phenotype into the less severe Becker phenotype.

b) RNA Modification

RNA editing is a natural process whereby the diversity of gene products of a given sequence is increased by minor modification in the RNA. Typically, the modification involves the conversion of adenosine (A) to inosine (I), resulting in an RNA sequence which is different from that encoded by the genome. RNA modification is generally ensured by the ADAR enzyme, whereby the pre-RNA target forms an imperfect duplex RNA by base-pairing between the exon that contains the adenosine to be edited and an intronic non-coding element. A classic example of A-I editing is the glutamate receptor GluR-B mRNA, whereby the change results in modified conductance properties of the channel (Higuchi M, et al. Cell. 1993; 75:1361-70).

In humans, a heterozygous functional-null mutation in the ADAR1 gene leads to a skin disease, human pigmentary genodermatosis (Miyamura Y, et al. Am J Hum Genet. 2003; 73:693-9). It is envisaged that the RNA targeting effector proteins of the present invention can be used to correct malfunctioning RNA modification.

It is further envisaged that RNA adenosine methylase (N(6)-methyladenosine) can be fused to the RNA targeting effector proteins of the invention and targeted to a transcript of interest. This methylase causes reversible methylation, has regulatory roles and may affect gene expression and cell fate decisions by modulating multiple RNA-related cellular pathways (Fu et al Nat Rev Genet. 2014; 15(5):293-306).

c) Polyadenylation

Polyadenylation of an mRNA is important for nuclear transport, translation efficiency and stability of the mRNA, and all of these, as well as the process of polyadenylation, depend on specific RBPs. Most eukaryotic mRNAs receive a 3' poly(A) tail of about 200 nucleotides after transcription. Polyadenylation involves different RNA-binding protein complexes which stimulate the activity of a poly(A)polymerase (Minvielle-Sebastia L et al. Curr Opin Cell Biol. 1999; 11:352-7). It is envisaged that the RNA-targeting effector proteins provided herein can be used to interfere with or promote the interaction between the RNA-binding proteins and RNA.

Examples of diseases which have been linked to defective proteins involved in polyadenylation are oculopharyngeal muscular dystrophy (OPMD) (Brais B, et al. Nat Genet. 1998; 18:164-7).

d) RNA Export

After pre-mRNA processing, the mRNA is exported from the nucleus to the cytoplasm. This is ensured by a cellular mechanism which involves the generation of a carrier complex, which is then translocated through the nuclear pore and releases the mRNA in the cytoplasm, with subsequent recycling of the carrier.

Overexpression of proteins (such as TAP) which play a role in the export of RNA has been found to increase export of transcripts that are otherwise inefficiently exported in *Xenopus* (Katahira J, et al. EMBO J. 1999; 18:2593-609).

e) mRNA Localization mRNA localization ensures spatially regulated protein production. Localization of transcripts to a specific region of the cell can be ensured by localization elements. In particular embodiments, it is envisaged that the effector proteins described herein can be used to target localization elements to the RNA of interest. The effector proteins can be designed to bind the target transcript and shuttle them to a location in the cell determined by its peptide signal tag. More particularly for instance, a RNA targeting effector protein fused to a nuclear localization signal (NLS) can be used to alter RNA localization.

Further examples of localization signals include the zipcode binding protein (ZBP1) which ensures localization of P-actin to the cytoplasm in several asymmetric cell types, KDEL retention sequence (localization to endoplasmic reticulum), nuclear export signal (localization to cytoplasm), mitochondrial targeting signal (localization to mitochondria), peroxisomal targeting signal (localization to peroxisome) and m6A marking/YTHDF2 (localization to p-bodies). Other approaches that are envisaged are fusion of the RNA targeting effector protein with proteins of known localization (for instance membrane, synapse).

Alternatively, the effector protein according to the invention may for instance be used in localization-dependent knockdown. By fusing the effector protein to a appropriate localization signal, the effector is targeted to a particular cellular compartment. Only target RNAs residing in this compartment will effectively be targeted, whereas otherwise identical targets, but residing in a different cellular compartment will not be targeted, such that a localization dependent knockdown can be established.

f) Translation

The RNA targeting effector proteins described herein can be used to enhance or repress translation. It is envisaged that upregulating translation is a very robust way to control cellular circuits. Further, for functional studies a protein translation screen can be favorable over transcriptional upregulation screens, which have the shortcoming that upregulation of transcript does not translate into increased protein production.

It is envisaged that the RNA targeting effector proteins described herein can be used to bring translation initiation factors, such as EIF4G in the vicinity of the 5' untranslated repeat (5'UTR) of a messenger RNA of interest to drive translation (as described in De Gregorio et al. EMBO J. 1999; 18(17):4865-74 for a non-reprogrammable RNA binding protein). As another example GLD2, a cytoplasmic poly(A) polymerase, can be recruited to the target mRNA by an RNA targeting effector protein. This would allow for directed polyadenylation of the target mRNA thereby stimulating translation.

Similarly, the RNA targeting effector proteins envisaged herein can be used to block translational repressors of mRNA, such as ZBP1 (Huttelmaier S, et al. Nature. 2005; 438:512-5). By binding to translation initiation site of a target RNA, translation can be directly affected.

In addition, fusing the RNA targeting effector proteins to a protein that stabilizes mRNAs, e.g. by preventing degradation thereof such as RNase inhibitors, it is possible to increase protein production from the transcripts of interest.

It is envisaged that the RNA targeting effector proteins described herein can be used to repress translation by binding in the 5' UTR regions of a RNA transcript and preventing the ribosome from forming and beginning translation.

Further, the RNA targeting effector protein can be used to recruit Caf1, a component of the CCR4-NOT deadenylase complex, to the target mRNA, resulting in deadenylation or the target transcript and inhibition of protein translation.

For instance, the RNA targeting effector protein of the invention can be used to increase or decrease translation of therapeutically relevant proteins. Examples of therapeutic applications wherein the RNA targeting effector protein can be used to downregulate or upregulate translation are in amyotrophic lateral sclerosis (ALS) and cardiovascular disorders. Reduced levels of the glial glutamate transporter EAAT2 have been reported in ALS motor cortex and spinal cord, as well as multiple abnormal EAAT2 mRNA transcripts in ALS brain tissue. Loss of the EAAT2 protein and function thought to be the main cause of excitotoxicity in ALS. Restoration of EAAT2 protein levels and function may provide therapeutic benefit. Hence, the RNA targeting effector protein can be beneficially used to upregulate the expression of EAAT2 protein, e.g. by blocking translational repressors or stabilizing mRNA as described above. Apolipoprotein A1 is the major protein component of high density lipoprotein (HDL) and ApoA1 and HDL are generally considered as atheroprotective. It is envisages that the RNA targeting effector protein can be beneficially used to upregulate the expression of ApoA1, e.g. by blocking translational repressors or stabilizing mRNA as described above.

g) mRNA Turnover

Translation is tightly coupled to mRNA turnover and regulated mRNA stability. Specific proteins have been described to be involved in the stability of transcripts (such as the ELAV/Hu proteins in neurons, Keene J D, 1999, Proc Natl Acad Sci USA. 96:5-7) and tristetraprolin (TTP). These proteins stabilize target mRNAs by protecting the messages from degradation in the cytoplasm (Peng S S et al., 1988, EMBO J. 17:3461-70).

It can be envisaged that the RNA-targeting effector proteins of the present invention can be used to interfere with or to promote the activity of proteins acting to stabilize mRNA transcripts, such that mRNA turnover is affected. For instance, recruitment of human TTP to the target RNA using the RNA targeting effector protein would allow for adenylate-uridylate-rich element (AU-rich element) mediated translational repression and target degradation. AU-rich elements are found in the 3' UTR of many mRNAs that code for proto-oncogenes, nuclear transcription factors, and cytokines and promote RNA stability. As another example, the RNA targeting effector protein can be fused to HuR, another mRNA stabilization protein (Hinman M N and Lou H, Cell Mol Life Sci 2008; 65:3168-81), and recruit it to a target transcript to prolong its lifetime or stabilize short-lived mRNA.

It is further envisaged that the RNA-targeting effector proteins described herein can be used to promote degradation of target transcripts. For instance, m6A methyltransferase can be recruited to the target transcript to localize the transcript to P-bodies leading to degradation of the target.

As yet another example, an RNA targeting effector protein as described herein can be fused to the non-specific endonuclease domain PilT N-terminus (PIN), to recruit it to a target transcript and allow degradation thereof.

Patients with paraneoplastic neurological disorder (PND)-associated encephalomyelitis and neuropathy are patients who develop autoantibodies against Hu-proteins in tumors outside of the central nervous system (Szabo A et al. 1991, Cell; 67:325-33 which then cross the blood-brain barrier. It can be envisaged that the RNA-targeting effector proteins of the present invention can be used to interfere with the binding of auto-antibodies to mRNA transcripts.

Patients with dystrophy type 1 (DM1), caused by the expansion of (CUG)n in the 3' UTR of dystrophia myotonica-protein kinase (DMPK) gene, are characterized by the accumulation of such transcripts in the nucleus. It is envisaged that the RNA targeting effector proteins of the invention fused with an endonuclease targeted to the (CUG)n repeats could inhibit such accumulation of aberrant transcripts.

h) Interaction with Multi-Functional Proteins

Some RNA-binding proteins bind to multiple sites on numerous RNAs to function in diverse processes. For instance, the hnRNP A1 protein has been found to bind exonic splicing silencer sequences, antagonizing the splicing factors, associate with telomere ends (thereby stimulating telomere activity) and bind miRNA to facilitate Drosha-mediated processing thereby affecting maturation. It is envisaged that the RNA-binding effector proteins of the present invention can interfere with the binding of RNA-binding proteins at one or more locations.

i) RNA Folding

RNA adopts a defined structure in order to perform its biological activities. Transitions in conformation among alternative tertiary structures are critical to most RNA-mediated processes. However, RNA folding can be associated with several problems. For instance, RNA may have a tendency to fold into, and be upheld in, improper alternative conformations and/or the correct tertiary structure may not be sufficiently thermodynamically favored over alternative structures. The RNA targeting effector protein, in particular a cleavage-deficient or dead RNA targeting protein, of the invention may be used to direct folding of (m)RNA and/or capture the correct tertiary structure thereof.

Use of RNA-Targeting Effector Protein in Modulating Cellular Status

In certain embodiments C2c2 in a complex with crRNA is activated upon binding to target RNA and subsequently cleaves any nearby ssRNA targets (i.e. "collateral" or "bystander" effects). C2c2, once primed by the cognate target, can cleave other (non-complementary) RNA molecules. Such promiscuous RNA cleavage could potentially cause cellular toxicity, or otherwise affect cellular physiology or cell status.

Accordingly, in certain embodiments, the non-naturally occurring or engineered composition, vector system, or delivery systems as described herein are used for or are for use in induction of cell dormancy. In certain embodiments, the non-naturally occurring or engineered composition, vector system, or delivery systems as described herein are used for or are for use in induction of cell cycle arrest. In certain embodiments, the non-naturally occurring or engineered composition, vector system, or delivery systems as described herein are used for or are for use in reduction of cell growth and/or cell proliferation. In certain embodiments, the non-naturally occurring or engineered composition, vector system, or delivery systems as described herein are used for or are for use in induction of cell anergy. In certain embodiments, the non-naturally occurring or engineered composition, vector system, or delivery systems as described herein are used for or are for use in induction of cell apoptosis. In certain embodiments, the non-naturally occurring or engineered composition, vector system, or delivery systems as described herein are used for or are for use in induction of cell necrosis. In certain embodiments, the non-naturally occurring or engineered composition, vector system, or delivery systems as described herein are used for or are for use in induction of cell death. In certain embodiments, the non-naturally occurring or engineered composition, vector system, or delivery systems as described herein are used for or are for use in induction of programmed cell death.

In certain embodiments, the invention relates to a method for induction of cell dormancy comprising introducing or inducing the non-naturally occurring or engineered composition, vector system, or delivery systems as described herein. In certain embodiments, the invention relates to a method for induction of cell cycle arrest comprising introducing or inducing the non-naturally occurring or engineered composition, vector system, or delivery systems as described herein. In certain embodiments, the invention relates to a method for reduction of cell growth and/or cell proliferation comprising introducing or inducing the non-naturally occurring or engineered composition, vector system, or delivery systems as described herein. In certain embodiments, the invention relates to a method for induction of cell anergy comprising introducing or inducing the non-naturally occurring or engineered composition, vector system, or delivery systems as described herein. In certain embodiments, the invention relates to a method for induction of cell apoptosis comprising introducing or inducing the non-naturally occurring or engineered composition, vector system, or delivery systems as described herein. In certain embodiments, the invention relates to a method for induction of cell necrosis comprising introducing or inducing the non-naturally occurring or engineered composition, vector system, or delivery systems as described herein. In certain embodiments, the invention relates to a method for induction of cell death comprising introducing or inducing the non-naturally occurring or engineered composition, vector system, or delivery systems as described herein. In certain embodiments, the invention relates to a method for induction of programmed cell death comprising introducing or inducing the non-naturally occurring or engineered composition, vector system, or delivery systems as described herein.

The methods and uses as described herein may be therapeutic or prophylactic and may target particular cells, cell (sub)populations, or cell/tissue types. In particular, the methods and uses as described herein may be therapeutic or prophylactic and may target particular cells, cell (sub) populations, or cell/tissue types expressing one or more target sequences, such as one or more particular target RNA (e.g. ss RNA). Without limitation, target cells may for instance be cancer cells expressing a particular transcript, e.g. neurons of a given class, (immune) cells causing e.g. autoimmunity, or cells infected by a specific (e.g. viral) pathogen, etc.

Accordingly, in certain embodiments, the invention relates to a method for treating a pathological condition characterized by the presence of undesirable cells (host cells), comprising introducing or inducing the non-naturally occurring or engineered composition, vector system, or delivery systems as described herein. In certain embodiments, the invention relates the use of the non-naturally occurring or engineered composition, vector system, or delivery systems as described herein for treating a pathological condition characterized by the presence of undesirable cells (host cells). In certain embodiments, the invention relates the non-naturally occurring or engineered composition, vector system, or delivery systems as described herein for use in treating a pathological condition characterized by the presence of undesirable cells (host cells). It is to be understood that preferably the CRISPR-Cas system targets a target specific for the undesirable cells. In certain embodiments, the invention relates to the use of the non-naturally occurring or engineered composition, vector system, or delivery systems as described herein for treating, preventing, or alleviating cancer. In certain embodiments, the invention relates to the non-naturally occurring or engineered composition, vector system, or delivery systems as described herein for use in treating, preventing, or alleviating cancer. In certain embodiments, the invention relates to a method for treating, preventing, or alleviating cancer comprising introducing or inducing the non-naturally occurring or engineered composition, vector system, or delivery systems as described herein. It is to be understood that preferably the CRISPR-Cas system targets a target specific for the cancer cells. In certain embodiments, the invention relates to the use of the non-naturally occurring or engineered composition, vector system, or delivery systems as described herein for treating, preventing, or alleviating infection of cells by a pathogen. In certain embodiments, the invention relates to the non-naturally occurring or engineered composition, vector system, or delivery systems as described herein for use in treating, preventing, or alleviating infection of cells by a pathogen. In certain embodiments, the invention relates to a method for treating, preventing, or alleviating infection of cells by a pathogen comprising introducing or inducing the non-naturally occurring or engineered composition, vector system, or delivery systems as described herein. It is to be understood that preferably the CRISPR-Cas system targets a target specific for the cells infected by the pathogen (e.g. a pathogen derived target). In certain embodiments, the invention relates to the use of the non-naturally occurring or engineered composition, vector system, or delivery systems as described herein for treating, preventing, or alleviating an autoimmune disorder. In certain embodiments, the invention relates to the non-naturally occurring or engineered composition, vector system, or delivery systems as described herein for use in treating, preventing, or alleviating an autoimmune disorder. In certain embodiments, the invention relates to a method for treating, preventing, or alleviating an autoimmune disorder comprising introducing or inducing the non-naturally occurring or engineered composition, vector system, or delivery systems as described herein. It is to be understood that preferably the CRISPR-Cas system targets a target specific for the cells responsible for the autoimmune disorder (e.g. specific immune cells).

Use of RNA-Targeting Effector Protein in RNA Detection

It is further envisaged that the RNA targeting effector protein can be used in Northern blot assays. Northern blotting involves the use of electrophoresis to separate RNA samples by size. The RNA targeting effector protein can be used to specifically bind and detect the target RNA sequence.

A RNA targeting effector protein can be fused to a fluorescent protein (such as GFP) and used to track RNA localization in living cells. More particularly, the RNA targeting effector protein can be inactivated in that it no longer cleaves RNA. In particular embodiments, it is envisaged that a split RNA targeting effector protein can be used, whereby the signal is dependent on the binding of both subproteins, in order to ensure a more precise visualization. Alternatively, a split fluorescent protein can be used that is reconstituted when multiple RNA targeting effector protein complexes bind to the target transcript. It is further envisaged that a transcript is targeted at multiple binding sites along the mRNA so the fluorescent signal can amplify the true signal and allow for focal identification. As yet another alternative, the fluorescent protein can be reconstituted form a split intein.

RNA targeting effector proteins are for instance suitably used to determine the localization of the RNA or specific splice variants, the level of mRNA transcript, up- or down-regulation of transcripts and disease-specific diagnosis. The RNA targeting effector proteins can be used for visualization of RNA in (living) cells using e.g. fluorescent microscopy or flow cytometry, such as fluorescence-activated cell sorting (FACS) which allows for high-throughput screening of cells and recovery of living cells following cell sorting. Further, expression levels of different transcripts can be assessed simultaneously under stress, e.g. inhibition of cancer growth using molecular inhibitors or hypoxic conditions on cells. Another application would be to track localization of transcripts to synaptic connections during a neural stimulus using two photon microscopy.

In certain embodiments, the components or complexes according to the invention as described herein can be used in multiplexed error-robust fluorescence in situ hybridization (MERFISH; Chen et al. Science; 2015; 348(6233)), such as for instance with (fluorescently) labeled C2c2 effectors.

In Vitro Apex Labeling

Cellular processes depend on a network of molecular interactions among protein, RNA, and DNA. Accurate detection of protein-DNA and protein-RNA interactions is key to understanding such processes. In vitro proximity labeling technology employs an affinity tag combined with e.g. a photoactivatable probe to label polypeptides and RNAs in the vicinity of a protein or RNA of interest in vitro. After UV irradiation the photoactivatable group reacts with proteins and other molecules that are in close proximity to the tagged molecule, thereby labelling them. Labelled interacting molecules can subsequently be recovered and identified. The RNA targeting effector protein of the invention can for instance be used to target a probe to a selected RNA sequence.

These applications could also be applied in animal models for in vivo imaging of disease relevant applications or difficult-to culture cell types. Use of RNA-targeting effector protein in RNA origami/in vitro assembly lines—combinatorics RNA origami refers to nanoscale folded structures for creating two-dimensional or three-dimensional structures using RNA as integrated template. The folded structure is encoded in the RNA and the shape of the resulting RNA is thus determined by the synthesized RNA sequence (Geary, et al. 2014. Science, 345 (6198). pp. 799-804). The RNA origami may act as scaffold for arranging other components, such as proteins, into complexes. The RNA targeting effector protein of the invention can for instance be used to target proteins of interest to the RNA origami using a suitable guide RNA.

These applications could also be applied in animal models for in vivo imaging of disease relevant applications or difficult-to culture cell types.

Use of RNA-Targeting Effector Protein in RNA Isolation or Purification, Enrichment or Depletion It is further envisages that the RNA targeting effector protein when complexed to RNA can be used to isolate and/or purify the RNA. The RNA targeting effector protein can for instance be fused to an affinity tag that can be used to isolate and/or purify the RNA-RNA targeting effector protein complex. Such applications are for instance useful in the analysis of gene expression profiles in cells.

In particular embodiments, it can be envisaged that the RNA targeting effector proteins can be used to target a specific noncoding RNA (ncRNA) thereby blocking its activity, providing a useful functional probe. In certain embodiments, the effector protein as described herein may be used to specifically enrich for a particular RNA (including but not limited to increasing stability, etc.), or alternatively to specifically deplete a particular RNA (such as without limitation for instance particular splice variants, isoforms, etc.).

Interrogation of lincRNA Function and Other Nuclear RNAs

Current RNA knockdown strategies such as siRNA have the disadvantage that they are mostly limited to targeting cytosolic transcripts since the protein machinery is cytosolic. The advantage of a RNA targeting effector protein of the present invention, an exogenous system that is not essential to cell function, is that it can be used in any compartment in the cell. By fusing a NLS signal to the RNA targeting effector protein, it can be guided to the nucleus, allowing nuclear RNAs to be targeted. It is for instance envisaged to probe the function of lincRNAs. Long intergenic non-coding RNAs (lincRNAs) are a vastly underexplored area of research. Most lincRNAs have as of yet unknown functions which could be studies using the RNA targeting effector protein of the invention.

Identification of RNA Binding Proteins

Identifying proteins bound to specific RNAs can be useful for understanding the roles of many RNAs. For instance, many lincRNAs associate with transcriptional and epigenetic regulators to control transcription. Understanding what proteins bind to a given lincRNA can help elucidate the components in a given regulatory pathway. A RNA targeting effector protein of the invention can be designed to recruit a biotin ligase to a specific transcript in order to label locally bound proteins with biotin. The proteins can then be pulled down and analyzed by mass spectrometry to identify them.

Assembly of Complexes on RNA and Substrate Shuttling

RNA targeting effector proteins of the invention can further be used to assemble complexes on RNA. This can be achieved by functionalizing the RNA targeting effector protein with multiple related proteins (e.g. components of a particular synthesis pathway). Alternatively, multiple RNA targeting effector proteins can be functionalized with such different related proteins and targeted to the same or adjacent target RNA. Useful application of assembling complexes on RNA are for instance facilitating substrate shuttling between proteins.

Synthetic Biology

The development of biological systems have a wide utility, including in clinical applications. It is envisaged that the programmable RNA targeting effector proteins of the invention can be used fused to split proteins of toxic domains for targeted cell death, for instance using cancer-linked RNA as target transcript. Further, pathways involving protein-protein interaction can be influenced in synthetic biological systems with e.g. fusion complexes with the appropriate effectors such as kinases or other enzymes.

Protein Splicing: Inteins

Protein splicing is a post-translational process in which an intervening polypeptide, referred to as an intein, catalyzes its own excision from the polypeptides flacking it, referred to as exteins, as well as subsequent ligation of the exteins. The assembly of two or more RNA targeting effector proteins as described herein on a target transcript could be used to direct the release of a split intein (Topilina and Mills Mob DNA. 2014 Feb. 4; 5(1):5), thereby allowing for direct computation of the existence of a mRNA transcript and subsequent release of a protein product, such as a metabolic enzyme or a transcription factor (for downstream actuation of transcription pathways). This application may have significant relevance in synthetic biology (see above) or large-scale bioproduction (only produce product under certain conditions).

Inducible, Dosed and Self-Inactivating Systems

In one embodiment, fusion complexes comprising an RNA targeting effector protein of the invention and an effector component are designed to be inducible, for instance light inducible or chemically inducible. Such inducibility allows for activation of the effector component at a desired moment in time.

Light inducibility is for instance achieved by designing a fusion complex wherein CRY2PHR/CIBN pairing is used for fusion. This system is particularly useful for light induction of protein interactions in living cells (Konermann S, et al. Nature. 2013; 500:472-476).

Chemical inducibility is for instance provided for by designing a fusion complex wherein FKBP/FRB (FK506 binding protein/FKBP rapamycin binding) pairing is used for fusion. Using this system rapamycin is required for binding of proteins (Zetsche et al. Nat Biotechnol. 2015; 33(2):139-42 describes the use of this system for Cas9).

Further, when introduced in the cell as DNA, the RNA targeting effector protein of the inventions can be modulated by inducible promoters, such as tetracycline or doxycycline controlled transcriptional activation (Tet-On and Tet-Off expression system), hormone inducible gene expression system such as for instance an ecdysone inducible gene expression system and an arabinose-inducible gene expression system. When delivered as RNA, expression of the RNA targeting effector protein can be modulated via a riboswitch, which can sense a small molecule like tetracycline (as described in Goldfless et al. Nucleic Acids Res. 2012; 40(9):e64).

In one embodiment, the delivery of the RNA targeting effector protein of the invention can be modulated to change the amount of protein or crRNA in the cell, thereby changing the magnitude of the desired effect or any undesired off-target effects.

In one embodiment, the RNA targeting effector proteins described herein can be designed to be self-inactivating. When delivered to a cell as RNA, either mRNA or as a replication RNA therapeutic (Wrobleska et al Nat Biotechnol. 2015 August; 33(8): 839-841), they can self-inactivate expression and subsequent effects by destroying the own RNA, thereby reducing residency and potential undesirable effects.

For further in vivo applications of RNA targeting effector proteins as described herein, reference is made to Mackay J P et al (Nat Struct Mol Biol. 2011 March; 18(3):256-61), Nelles et al (Bioessays. 2015 July; 37(7):732-9) and Abil Z and Zhao H (Mol Biosyst. 2015 October; 11(10):2658-65), which are incorporated herein by reference. In particular, the following applications are envisaged in certain embodiments of the invention, preferably in certain embodiments by using catalytically inactive C2c2: enhancing translation (e.g. C2c2—translation promotion factor fusions (e.g. eIF4 fusions)); repressing translation (e.g. gRNA targeting ribosome binding sites); exon skipping (e.g. gRNAs targeting splice donor and/or acceptor sites); exon inclusion (e.g. gRNA targeting a particular exon splice donor and/or acceptor site to be included or C2c2 fused to or recruiting spliceosome components (e.g. U1 snRNA)); accessing RNA localization (e.g. C2c2—marker fusions (e.g. EGFP fusions)); altering RNA localization (e.g. C2c2—localization signal fusions (e.g. NLS or NES fusions)); RNA degradation (in this case no catalytically inactive C2c2 is to be used if relied on the activity of C2c2, alternatively and for increased specificity, a split C2c2 may be used); inhibition of non-coding RNA function (e.g. miRNA), such as by degradation or binding of gRNA to functional sites (possibly titrating out at specific sites by relocalization by C2c2-signal sequence fusions).

As described herein before and demonstrated in the Examples, C2c2 function is robust to 5' or 3' extensions of the crRNA and to extension of the crRNA loop. It is therefore envisages that MS2 loops and other recruitment domains can be added to the crRNA without affecting complex formation and binding to target transcripts. Such modifications to the crRNA for recruitment of various effector domains are applicable in the uses of a RNA targeted effector proteins described above.

As demonstrated in the Examples, C2c2, in particular LshC2c2, is capable of mediating resistance to RNA phages. It is therefore envisaged that C2c2 can be used to immunize, e.g. animals, humans and plants, against RNA-only pathogens, including but not limited to Ebola virus and Zika virus.

The present inventors have shown that C2c2 can processes (cleaves) its own array. This applies to both the wildtype C2c2 protein and the mutated C2c2 protein containing one or more mutated amino acid residues R597, H602, R1278 and H1283, such as one or more of the modifications selected from R597A, H602A, R1278A and H1283A. It is therefore envisaged that multiple crRNAs designed for different target transcripts and/or applications can be delivered as a single pre-crRNA or as a single transcript driven by one promotor. Such method of delivery has the advantages that it is substantially more compact, easier to synthesize and easier to delivery in viral systems. Preferably, amino acid numbering as described herein refers to Lsh C2c2 protein. It will be understood that exact amino acid positions may vary for orthologues of Lsh C2c2, which can be adequately determined by protein alignment, as is known in the art, and as described herein elsewhere.

Aspects of the invention also encompass methods and uses of the compositions and systems described herein in genome engineering, e.g. for altering or manipulating the expression of one or more genes or the one or more gene products, in prokaryotic or eukaryotic cells, in vitro, in vivo or ex vivo.

In an aspect, the invention provides methods and compositions for modulating, e.g., reducing, expression of a target RNA in cells. In the subject methods, a C2c2 system of the invention is provided that interferes with transcription, stability, and/or translation of an RNA.

In certain embodiments, an effective amount of C2c2 system is used to cleave RNA or otherwise inhibit RNA expression. In this regard, the system has uses similar to siRNA and shRNA, thus can also be substituted for such methods. The method includes, without limitation, use of a C2c2 system as a substitute for e.g., an interfering ribonucleic acid (such as an siRNA or shRNA) or a transcription template thereof, e.g., a DNA encoding an shRNA. The C2c2 system is introduced into a target cell, e.g., by being administered to a mammal that includes the target cell.

Advantageously, a C2c2 system of the invention is specific. For example, whereas interfering ribonucleic acid (such as an siRNA or shRNA) polynucleotide systems are plagued by design and stability issues and off-target binding, a C2c2 system of the invention can be designed with high specificity.

Destabilized C2c2

In certain embodiments, the effector protein (CRISPR enzyme; C2c2) according to the invention as described herein is associated with or fused to a destabilization domain (DD). In some embodiments, the DD is ER50. A corresponding stabilizing ligand for this DD is, in some embodiments, 4HT. As such, in some embodiments, one of the at least one DDs is ER50 and a stabilizing ligand therefor is 4HT or CMP8. In some embodiments, the DD is DHFR50. A corresponding stabilizing ligand for this DD is, in some embodiments, TMP. As such, in some embodiments, one of the at least one DDs is DHFR50 and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art the skilled person can use CMP8 and/or 4HT.

In some embodiments, one or two DDs may be fused to the N-terminal end of the CRISPR enzyme with one or two DDs fused to the C-terminal of the CRISPR enzyme. In some embodiments, the at least two DDs are associated with the CRISPR enzyme and the DDs are the same DD, i.e. the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the CRISPR enzyme and the DDs are different DDs, i.e. the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N or C-term may enhance degradation; and such a tandem fusion can be, for example ER50-ER50-C2c2 or DHFR-DHFR-C2c2 It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the CRISPR enzyme with the DD comprises a linker between the DD and the CRISPR enzyme. In some embodiments, the linker is a GlySer linker. In some embodiments, the DD-CRISPR enzyme further comprises at least one Nuclear Export Signal (NES). In some embodiments, the DD-CRISPR enzyme comprises two or more NESs. In some embodiments, the DD-CRISPR enzyme comprises at least one Nuclear Localization Signal (NLS). This may be in addition to an NES. In some embodiments, the CRISPR enzyme comprises or consists essentially of or consists of a localization (nuclear import or export) signal as, or as part of, the linker between the CRISPR enzyme and the DD. HA or Flag tags are also within the ambit of the invention as linkers. Applicants use NLS and/or NES as linker and also use Glycine Serine linkers as short as GS up to (GGGGS)3.

Destabilizing domains have general utility to confer instability to a wide range of proteins; see, e.g., Miyazaki, J Am Chem Soc. Mar. 7, 2012; 134(9): 3942-3945, incorporated herein by reference. CMP8 or 4-hydroxytamoxifen can be destabilizing domains. More generally, A temperature-sensitive mutant of mammalian DHFR (DHFRts), a destabilizing residue by the N-end rule, was found to be stable at a permissive temperature but unstable at 37° C. The addition of methotrexate, a high-affinity ligand for mammalian DHFR, to cells expressing DHFRts inhibited degradation of the protein partially. This was an important demonstration that a small molecule ligand can stabilize a protein otherwise targeted for degradation in cells. A rapamycin derivative was used to stabilize an unstable mutant of the FRB domain of mTOR (FRB*) and restore the function of the fused kinase, GSK-3β.6,7. This system demonstrated that ligand-dependent stability represented an attractive strategy to regulate the function of a specific protein in a complex biological environment. A system to control protein activity can involve the DD becoming functional when the ubiquitin complementation occurs by rapamycin induced dimerization of FK506-binding protein and FKBP12. Mutants of human FKBP12 or ecDHFR protein can be engineered to be metabolically unstable in the absence of their high-affinity ligands, Shield-1 or trimethoprim (TMP), respectively. These mutants are some of the possible destabilizing domains (DDs) useful in the practice of the invention and instability of a DD as a fusion with a CRISPR enzyme confers to the CRISPR protein degradation of the entire fusion protein by the proteasome. Shield-1 and TMP bind to and stabilize the DD in a dose-dependent manner. The estrogen receptor ligand binding domain (ERLBD, residues 305-549 of ERS1) can also be engineered as a destabilizing domain. Since the estrogen receptor signaling pathway is involved in a variety of diseases such as breast cancer, the pathway has been widely studied and numerous agonist and antagonists of estrogen receptor have been developed. Thus, compatible pairs of ERLBD and drugs are known. There are ligands that bind to mutant but not wild-type forms of the ERLBD. By using one of these mutant domains encoding three mutations (L384M, M421G, G521R)12, it is possible to regulate the stability of an ERLBD-derived DD using a ligand that does not perturb endogenous estrogen-sensitive networks. An additional mutation (Y537S) can be introduced to further destabilize the ERLBD and to configure it as a potential DD candidate. This tetra-mutant is an advantageous DD development. The mutant ERLBD can be fused to a CRISPR enzyme and its stability can be regulated or perturbed using a ligand, whereby the CRISPR enzyme has a DD. Another DD can be a 12-kDa (107-amino-acid) tag based on a mutated FKBP protein, stabilized by Shield1 ligand; see, e.g., Nature Methods 5, (2008). For instance a DD can be a modified FK506 binding protein 12 (FKBP12) that binds to and is reversibly stabilized by a synthetic, biologically inert small molecule, Shield-1; see, e.g., Banaszynski L A, Chen L C, Maynard-Smith L A, Ooi A G, Wandless T J. A rapid, reversible, and tunable method to regulate protein function in living cells using synthetic small molecules. Cell. 2006; 126:995-1004; Banaszynski L A, Sellmyer M A, Contag C H, Wandless T J, Thorne S H. Chemical control of protein stability and function in living mice. Nat Med. 2008; 14:1123-1127; Maynard-Smith L A, Chen L C, Banaszynski L A, Ooi A G, Wandless T J. A directed approach for engineering conditional protein stability using biologically silent small molecules. The Journal of biological chemistry. 2007; 282:24866-24872; and Rodriguez, Chem Biol. Mar. 23, 2012; 19(3): 391-398—all of which are incorporated herein by reference and may be employed in the practice of the invention in selected a DD to associate with a CRISPR enzyme in the practice of this invention. As can be seen, the knowledge in the art includes a number of DDs, and the DD can be associated with, e.g., fused to, advantageously with a linker, to a CRISPR enzyme, whereby the DD can be stabilized in the presence of a ligand and when there is the absence thereof the DD can become destabilized, whereby the CRISPR enzyme is entirely destabilized, or the DD can be stabilized in the absence of a ligand and when the ligand is present the DD can become destabilized; the DD allows the CRISPR enzyme and hence the CRISPR-Cas complex or system to be regulated or controlled-turned on or off so to speak, to thereby provide means for regulation or control of the system, e.g., in an in vivo or in vitro environment. For instance, when a protein of interest is expressed as a fusion with the DD tag, it is destabilized and rapidly degraded in the cell, e.g., by proteasomes. Thus, absence of stabilizing ligand leads to a D associated Cas being degraded. When a new DD is fused to a protein of interest, its instability is conferred to the protein of interest, resulting in the rapid degradation of the entire fusion protein. Peak activity for Cas is sometimes beneficial to reduce off-target effects. Thus, short bursts of high activity are preferred. The present invention is able to provide such peaks. In some senses the system is inducible. In some other senses, the system repressed in the absence of stabilizing ligand and de-repressed in the presence of stabilizing ligand.

Application of RNA Targeting-CRISPR System to Plants and Yeast

Definitions

In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, eucalyptus, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, *papaya*, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for modulating gene expression using the RNA targeting system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., *petunia*, rose, *chrysanthemum*), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Thus, the methods and CRISPR-Cas systems can be used over a broad range of plants, such as for example with dicotyledonous plants belonging to the orders Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; the methods and CRISPR-Cas systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales, or with plants belonging to Gymnospermae, e.g. those belonging to the orders Pinales, Ginkgoales, Cycadales, Araucariales, Cupressales and Gnetales.

The RNA targeting CRISPR systems and methods of use described herein can be used over a broad range of plant species, included in the non-limitative list of dicot, monocot or gymnosperm genera hereunder: *Atropa, Alseodaphne, Anacardium, Arachis, Beischmiedia, Brassica, Carthamus, Cocculus, Croton, Cucumis, Cinis, Citrullus, Capsicum, Catharanthus, Cocos, Cofea, Cucurbita, Daucus, Duguetia, Eschscholzia, Ficus, Fragaria, Glaucium, Glycine, Gossypium, Helianthus Hevea, Hyoscyamus, Lactuca, Landolphia, Limim, Litsea, Lvcopersicon, Lupimis, Manihot, Majorana, Malus, Medicago, Nicotiana, Olea, Parthenium, Papaver, Persea, Phaseolus, Pistacia, Pisum, Pyrus, Prumis, Raphanus, Ricinus, Senecio, Sinomenium, Stephania Sinapis, Solanum, Theobrora, Trifolium, Trigonella, Vicia, Vinca, Vilis,* and *Vigna*; and the genera *Allium, Andropogon, Aragrostis, Asparagus, Avena, Cynodon, Elaeis, Festuca, Festulolium, Heterocallis, Hordeum, Lemna, Lolium, Musa, Oryza, Panicum, Pannesetum, Phleum, Poa, Secale, Sorghum, Triticum, Zea, Abies, Cunninghamia, Ephedra, Picea, Pimis,* and *Pseudotsuga*.

The RNA targeting CRISPR systems and methods of use can also be used over a broad range of "algae" or "algae cells"; including for example algea selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Anikstrodesmis, Botryococcus, Chaetoceros, Chlamydomonas, Chlorella, Chlorococcum, Cyclotella, Cylindrotheca, Dunaliella, Emiliana, Euglena, Hematococcus, Isochrysis, Monochrysis, Monoraphidium, Nannochloris, Nannnochloropsis, Navicula, Nephrochloris, Nephroselmis, Nitzschia, Nodularia, Nostoc, Oochromonas, Oocystis, Oscillartoria, Pavlova, Phaeodactylum, Playtmonas, Pleurochrysis, Porhyra, Pseudoanabaena, Pyramimonas, Stichococcus, Synechococcus, Synechocystis, Tetraselmis, Thalassiosira,* and *Trichodesmium*.

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendants of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerervisiae, Kluyveromyces marxianus,* or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and *Issatchenkia* spp. (e.g., Issatchenkia *orientalis*, a.k.a. *Pichia kudriavzevii* and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guideRNA may more often be a rate-limiting component in genome engineering of polyploid cells than in haploid cells, and thus the methods using the C2c2 CRISPRS system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the S. cerevisiae strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the S. cerevisiae strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2p plasmids, yeast integrative plasmids, yeast replicative plasmids, shuttle vectors, and episomal plasmids.

Stable Integration of RNA Targeting CRISP System Components in the Genome of Plants and Plant Cells In particular embodiments, it is envisaged that the polynucleotides encoding the components of the RNA targeting CRISPR system are introduced for stable integration into the genome of a plant cell. In these embodiments, the design of the transformation vector or the expression system can be adjusted depending on when, where and under what conditions the guide RNA and/or the RNA targeting gene(s) are expressed.

In particular embodiments, it is envisaged to introduce the components of the RNA targeting CRISPR system stably into the genomic DNA of a plant cell. Additionally or alternatively, it is envisaged to introduce the components of the RNA targeting CRISPR system for stable integration into the DNA of a plant organelle such as, but not limited to a plastid, e mitochondrion or a chloroplast.

The expression system for stable integration into the genome of a plant cell may contain one or more of the following elements: a promoter element that can be used to express the guide RNA and/or RNA targeting enzyme in a plant cell; a 5' untranslated region to enhance expression; an intron element to further enhance expression in certain cells, such as monocot cells; a multiple-cloning site to provide convenient restriction sites for inserting the one or more guide RNAs and/or the RNA targeting gene sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a RNA targeting CRISPR expression system comprises at least:
 (a) a nucleotide sequence encoding a guide RNA (gRNA) that hybridizes with a target sequence in a plant, and wherein the guide RNA comprises a guide sequence and a direct repeat sequence, and
 (b) a nucleotide sequence encoding a RNA targeting protein,
wherein components (a) or (b) are located on the same or on different constructs, and whereby the different nucleotide sequences can be under control of the same or a different regulatory element operable in a plant cell.

DNA construct(s) containing the components of the RNA targeting CRISPR system, and, where applicable, template sequence may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom.

In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1):11-9). The basis of particle bombardment is the acceleration of particles coated with gene/s of interest toward cells, resulting in the penetration of the protoplasm by the particles and typically stable integration into the genome. (see e.g. Klein et al, Nature (1987), Klein et ah, Bio/Technology (1992), Casas et ah, Proc. Natl. Acad. Sci. USA (1993)).

In particular embodiments, the DNA constructs containing components of the RNA targeting CRISPR system may be introduced into the plant by *Agrobacterium*-mediated transformation. The DNA constructs may be combined with suitable T-DNA flanking regions and introduced into a conventional *Agrobacterium tumefaciens* host vector. The foreign DNA can be incorporated into the genome of plants by infecting the plants or by incubating plant protoplasts with *Agrobacterium* bacteria, containing one or more Ti (tumor-inducing) plasmids. (see e.g. Fraley et al., (1985), Rogers et al., (1987) and U.S. Pat. No. 5,563,055).

Plant Promoters

In order to ensure appropriate expression in a plant cell, the components of the C2c2 CRISPR system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. The present invention envisages methods for modifying RNA sequences and as such also envisages regulating expression of plant biomolecules. In particular embodiments of the present invention it is thus advantageous to place one or more elements of the RNA targeting CRISPR system under the control of a promoter that can be regulated. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular embodiments, one or more of the RNA targeting CRISPR components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the RNA targeting CRISPR system—are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

Examples of promoters that are inducible and that allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc), or light inducible systems (Phytochrome, LOV domains, or cryptochrome), such as a Light Inducible Transcriptional Effector (LITE) that direct changes in transcriptional activity in a sequence-specific manner. The components of a light inducible system may include a RNA targeting CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, which is hereby incorporated by reference in its entirety.

In particular embodiments, transient or inducible expression can be achieved by using, for example, chemical-regulated promotors, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize In2-2 promoter, activated by benzene sulfonamide herbicide safeners (De Veylder et al., (1997) Plant Cell Physiol 38:568-77), the maize GST promoter (GST-11-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chloroplast Targeting

In particular embodiments, it is envisaged that the RNA targeting CRISPR system is used to specifically modify expression and/or translation of chloroplast genes or to ensure expression in the chloroplast. For this purpose use is made of chloroplast transformation methods or compartimentalization of the RNA targeting CRISPR components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the plastid can be used as described in WO2010061186.

Alternatively, it is envisaged to target one or more of the RNA targeting CRISPR components to the plant chloroplast. This is achieved by incorporating in the expression construct a sequence encoding a chloroplast transit peptide (CTP) or plastid transit peptide, operably linked to the 5' region of the sequence encoding the RNA targeting protein. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments it is also desired to target the one or more guide RNAs to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the RNA targeting-guide RNA(s).

Introduction of Polynucleotides Encoding the CRISPR-RNA Targeting System in Algal Cells.

Transgenic algae (or other plants such as rape) may be particularly useful in the production of vegetable oils or biofuels such as alcohols (especially methanol and ethanol)

or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the RNA targeting CRISPR system described herein can be applied on *Chlamydomonas* species and other algae. In particular embodiments, RNA targeting protein and guide RNA(s) are introduced in algae expressed using a vector that expresses RNA targeting protein under the control of a constitutive promoter such as Hsp70A-Rbc S2 or Beta2-tubulin. Guide RNA is optionally delivered using a vector containing T7 promoter. Alternatively, RNA targeting mRNA and in vitro transcribed guide RNA can be delivered to algal cells. Electroporation protocols are available to the skilled person such as the standard recommended protocol from the GeneArt *Chlamydomonas* Engineering kit.

Introduction of Polynucleotides Encoding RNA Targeting Components in Yeast Cells In particular embodiments, the invention relates to the use of the RNA targeting CRISPR system for RNA editing in yeast cells. Methods for transforming yeast cells which can be used to introduce polynucleotides encoding the RNA targeting CRISPR system components are well known to the artisan and are reviewed by Kawai et al., 2010, Bioeng Bugs. 2010 November-December; 1(6): 395-403). Non-limiting examples include transformation of yeast cells by lithium acetate treatment (which may further include carrier DNA and PEG treatment), bombardment or by electroporation.

Transient Expression of RNA Targeting CRISP System Components in Plants and Plant Cell In particular embodiments, it is envisaged that the guide RNA and/or RNA targeting gene are transiently expressed in the plant cell. In these embodiments, the RNA targeting CRISPR system can ensure modification of RNA target molecules only when both the guide RNA and the RNA targeting protein is present in a cell, such that gene expression can further be controlled. As the expression of the RNA targeting enzyme is transient, plants regenerated from such plant cells typically contain no foreign DNA. In particular embodiments the RNA targeting enzyme is stably expressed by the plant cell and the guide sequence is transiently expressed.

In particularly preferred embodiments, the RNA targeting CRISPR system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., *Faba* bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors, which is of interest in the context of avoiding the production of GMO plants.

In particular embodiments, the vector used for transient expression of RNA targeting CRISPR constructs is for instance a pEAQ vector, which is tailored for *Agrobacterium*-mediated transient expression (Sainsbury F. et al., Plant Biotechnol J. 2009 September; 7(7):682-93) in the protoplast. Precise targeting of genomic locations was demonstrated using a modified Cabbage Leaf Curl virus (CaL-CuV) vector to express gRNAs in stable transgenic plants expressing a CRISPR enzyme (Scientific Reports 5, Article number: 14926 (2015), doi:10.1038/srep14926).

In particular embodiments, double-stranded DNA fragments encoding the guide RNA and/or the RNA targeting gene can be transiently introduced into the plant cell. In such embodiments, the introduced double-stranded DNA fragments are provided in sufficient quantity to modify RNA molecule(s) in the cell but do not persist after a contemplated period of time has passed or after one or more cell divisions. Methods for direct DNA transfer in plants are known by the skilled artisan (see for instance Davey et al. Plant Mol Biol. 1989 September; 13(3):273-85.)

In other embodiments, an RNA polynucleotide encoding the RNA targeting protein is introduced into the plant cell, which is then translated and processed by the host cell generating the protein in sufficient quantity to modify the RNA molecule(s) cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122). Combinations of the different methods described above are also envisaged.

Delivery of RNA Targeting CRISPR Components to the Plant Cell

In particular embodiments, it is of interest to deliver one or more components of the RNA targeting CRISPR system directly to the plant cell. This is of interest, inter alia, for the generation of non-transgenic plants (see below). In particular embodiments, one or more of the RNA targeting components is prepared outside the plant or plant cell and delivered to the cell. For instance in particular embodiments, the RNA targeting protein is prepared in vitro prior to introduction to the plant cell. RNA targeting protein can be prepared by various methods known by one of skill in the art and include recombinant production. After expression, the RNA targeting protein is isolated, refolded if needed, purified and optionally treated to remove any purification tags, such as a His-tag. Once crude, partially purified, or more completely purified RNA targeting protein is obtained, the protein may be introduced to the plant cell.

In particular embodiments, the RNA targeting protein is mixed with guide RNA targeting the RNA of interest to form a pre-assembled ribonucleoprotein.

The individual components or pre-assembled ribonucleoprotein can be introduced into the plant cell via electroporation, by bombardment with RNA targeting-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. *Nature Biotechnology*, 2015; DOI: 10.1038/nbt.3389). These methods can be modified to achieve targeted modification of RNA molecules in the plants.

In particular embodiments, the RNA targeting CRISPR system components are introduced into the plant cells using nanoparticles. The components, either as protein or nucleic acid or in a combination thereof, can be uploaded onto or packaged in nanoparticles and applied to the plants (such as for instance described in WO 2008042156 and US 20130185823). In particular, embodiments of the invention comprise nanoparticles uploaded with or packed with DNA molecule(s) encoding the RNA targeting protein, DNA molecules encoding the guide RNA and/or isolated guide RNA as described in WO2015089419.

Further means of introducing one or more components of the RNA targeting CRISPR system to the plant cell is by using cell penetrating peptides (CPP). Accordingly, in particular, embodiments the invention comprises compositions comprising a cell penetrating peptide linked to an RNA targeting protein. In particular embodiments of the present invention, an RNA targeting protein and/or guide RNA(s) is coupled to one or more CPPs to effectively transport them inside plant protoplasts (Ramakrishna (2014, Genome Res. 2014 June; 24(6):1020-7 for Cas9 in human cells). In other embodiments, the RNA targeting gene and/or guide RNA(s) are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipatic peptides, peptides having proline-rich and antimicrobial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biomolecule with the target. Examples of CPP include amongst others: Tat, a nuclear transcriptional activator protein required for viral replication by HIV type1, penetratin, Kaposi fibroblast growth factor (FGF) signal peptide sequence, integrin β3 signal peptide sequence; polyarginine peptide Args sequence, Guanine rich-molecular transporters, sweet arrow peptide, etc.

Target RNA Envisaged for Plant, Algae or Fungal Applications

The target RNA, i.e. the RNA of interest, is the RNA to be targeted by the present invention leading to the recruitment to, and the binding of the RNA targeting protein at, the target site of interest on the target RNA. The target RNA may be any suitable form of RNA. This may include, in some embodiments, mRNA. In other embodiments, the target RNA may include transfer RNA (tRNA) or ribosomal RNA (rRNA). In other embodiments the target RNA may include interfering RNA (RNAi), microRNA (miRNA), microswitches, microzymes, satellite RNAs and RNA viruses. The target RNA may be located in the cytoplasm of the plant cell, or in the cell nucleus or in a plant cell organelle such as a mitochondrion, chloroplast or plastid.

In particular embodiments, the RNA targeting CRISPR system is used to cleave RNA or otherwise inhibit RNA expression.

Use of RNA Targeting CRISPR System for Modulating Plant Gene Expression Via RNA Modulation The RNA targeting protein may also be used, together with a suitable guide RNA, to target gene expression, via control of RNA processing. The control of RNA processing may include RNA processing reactions such as RNA splicing, including alternative splicing; viral replication (in particular of plant viruses, including virioids in plants and tRNA biosynthesis. The RNA targeting protein in combination with a suitable guide RNA may also be used to control RNA activation (RNAa). RNAa leads to the promotion of gene expression, so control of gene expression may be achieved that way through disruption or reduction of RNAa and thus less promotion of gene expression.

The RNA targeting effector protein of the invention can further be used for antiviral activity in plants, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. provided is therefore the use of an RNA targeting effector protein of the invention as an antiviral agent. Examples of viruses that can be counteracted in this way include, but are not limited to, Tobacco mosaic virus (TMV), Tomato spotted wilt virus (TSWV), Cucumber mosaic virus (CMV), Potato virus Y (PVY), Cauliflower mosaic virus (CaMV) (RT virus), Plum pox virus (PPV), Brome mosaic virus (BMV) and Potato virus X (PVX).

Examples of modulating RNA expression in plants, algae or fungi, as an alternative of targeted gene modification are described herein further.

Of particular interest is the regulated control of gene expression through regulated cleavage of mRNA. This can be achieved by placing elements of the RNA targeting under the control of regulated promoters as described herein.

Use of the RNA Targeting CRISPR System to Restore the Functionality of tRNA Molecules.

Pring et al describe RNA editing in plant mitochondria and chloroplasts that alters mRNA sequences to code for different proteins than the DNA. (Plant Mol. Biol. (1993) 21 (6): 1163-1170. doi:10.1007/BF00023611). In particular embodiments of the invention, the elements of the RNA targeting CRISPR system specifically targeting mitochondrial and chloroplast mRNA can be introduced in a plant or plant cell to express different proteins in such plant cell organelles mimicking the processes occurring in vivo.

Use of the RNA Targeting CRISPR System as an Alternative to RNA Interference to Inhibit RNA Expression.

The RNA targeting CRISPR system has uses similar to RNA inhibition or RNA interference, thus can also be substituted for such methods. In particular embodiment, the methods of the present invention include the use of the RNA targeting CRISPR as a substitute for e.g. an interfering ribonucleic acid (such as an siRNA or shRNA or a dsRNA). Examples of inhibition of RNA expression in plants, algae or fungi as an alternative of targeted gene modification are described herein further.

Use of the RNA Targeting CRISPR System to Control RNA Interference.

Control over interfering RNA or miRNA may help reduce off-target effects (OTE) seen with those approaches by reducing the longevity of the interfering RNA or miRNA in vivo or in vitro. In particular embodiments, the target RNA may include interfering RNA, i.e. RNA involved in an RNA interference pathway, such as shRNA, siRNA and so forth. In other embodiments, the target RNA may include microRNA (miRNA) or double stranded RNA (dsRNA).

In other particular embodiments, if the RNA targeting protein and suitable guide RNA(s) are selectively expressed (for example spatially or temporally under the control of a regulated promoter, for example a tissue- or cell cycle-specific promoter and/or enhancer) this can be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The RNA targeting protein may be used to control or bind to molecules comprising or consisting of RNA, such as ribozymes, ribosomes or riboswitches. In embodiments of the invention, the guide RNA can recruit the RNA targeting protein to these molecules so that the RNA targeting protein is able to bind to them.

The RNA targeting CRISPR system of the invention can be applied in areas of in-planta RNAi technologies, without undue experimentation, from this disclosure, including insect pest management, plant disease management and management of herbicide resistance, as well as in plant assay and for other applications (see, for instance Kim et al., in Pesticide Biochemistry and Physiology (Impact Factor: 2.01). 01/2015; 120. DOI: 10.1016j.pestbp.2015.01.002; Sharma et al. in Academic Journals (2015), Vol. 12(18) pp 2303-2312); Green J. M, inPest Management Science, Vol 70(9), pp 1351-1357), because the present application provides the foundation for informed engineering of the system.

Use of RNA Targeting CRISPR System to Modify Riboswitches and Control Metabolic Regulation in Plants, Algae and Fungi Riboswitches (also known as aptozymes) are regulatory segments of messenger RNA that bind small molecules and in turn regulate gene expression. This mechanism allows the cell to sense the intracellular concentration of these small molecules. A particular riboswitch typically regulates its adjacent gene by altering the transcription, the translation or the splicing of this gene. Thus, in particular embodiments of the present invention, control of riboswitch activity is envisaged through the use of the RNA targeting protein in combination with a suitable guide RNA to target the riboswitch. This may be through cleavage of, or binding to, the riboswitch. In particular embodiments, reduction of riboswitch activity is envisaged. Recently, a riboswitch that binds thiamin pyrophosphate (TPP) was characterized and found to regulate thiamin biosynthesis in plants and algae. Furthermore it appears that this element is an essential regulator of primary metabolism in plants (Bocobza and Aharoni, Plant J. 2014 August; 79(4):693-703. doi: 10.1111/tpj.12540. Epub 2014 Jun. 17). TPP riboswitches are also found in certain fungi, such as in Neurospora crassa, where it controls alternative splicing to conditionally produce an Upstream Open Reading Frame (uORF), thereby affecting the expression of downstream genes (Cheah M T et al., (2007) Nature 447 (7143): 497-500. doi:10.1038/nature05769) The RNA targeting CRISPR system described herein may be used to manipulate the endogenous riboswitch activity in plants, algae or fungi and as such alter the expression of downstream genes controlled by it. In particular embodiments, the RNA targeting CRISP system may be used in assaying riboswitch function in vivo or in vitro and in studying its relevance for the metabolic network. In particular embodiments the RNA targeting CRISPR system may potentially be used for engineering of riboswitches as metabolite sensors in plants and platforms for gene control.

Use of RNA Targeting CRISPR System in RNAi Screens for Plants, Algae or Fungi

Identifying gene products whose knockdown is associated with phenotypic changes, biological pathways can be interrogated and the constituent parts identified, via RNAi screens. In particular embodiments of the invention, control may also be exerted over or during these screens by use of the Guide 29 or Guide 30 protein and suitable guide RNA described herein to remove or reduce the activity of the RNAi in the screen and thus reinstate the activity of the (previously interfered with) gene product (by removing or reducing the interference/repression).

Use of RNA Targeting Proteins for Visualization of RNA Molecules In Vivo and In Vitro In particular embodiments, the invention provides a nucleic acid binding system. In situ hybridization of RNA with complementary probes is a powerful technique. Typically fluorescent DNA oligonucleotides are used to detect nucleic acids by hybridization. Increased efficiency has been attained by certain modifications, such as locked nucleic acids (LNAs), but there remains a need for efficient and versatile alternatives. As such, labelled elements of the RNA targeting system can be used as an alternative for efficient and adaptable system for in situ hybridization Further Applications of the RNA Targeting CRISPR System in Plants and Yeasts Use of RNA Targeting CRISPR System in Biofuel Production The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the RNA targeting CRISPR system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488).

Modifying Yeast for Biofuel Production

In particular embodiments, the RNA targeting enzyme provided herein is used for bioethanol production by recombinant micro-organisms. For instance, RNA targeting enzymes can be used to engineer micro-organisms, such as yeast, to generate biofuel or biopolymers from fermentable sugars and optionally to be able to degrade plant-derived lignocellulose derived from agricultural waste as a source of fermentable sugars. More particularly, the invention provides methods whereby the RNA targeting CRISPR complex is used to modify the expression of endogenous genes required for biofuel production and/or to modify endogenous genes why may interfere with the biofuel synthesis. More particularly the methods involve stimulating the expression in a micro-organism such as a yeast of one or more nucleotide sequence encoding enzymes involved in the conversion of pyruvate to ethanol or another product of interest. In particular embodiments the methods ensure the stimulation of expression of one or more enzymes which allows the micro-organism to degrade cellulose, such as a cellulase. In yet further embodiments, the RNA targeting CRISPR complex is used to suppress endogenous metabolic pathways which compete with the biofuel production pathway.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the RNA targeting CRISPR system described herein can be applied on *Chlamydomonas* species and other algae. In particular embodiments, the RNA targeting effetor protein and guide RNA are introduced in algae expressed using a vector that expresses the RNA targeting effector protein under the control of a constitutive promoter such as Hsp70A-Rbc S2 or Beta2-tubulin. Guide RNA will be delivered using a vector containing T7 promoter. Alternatively, in vitro transcribed guide RNA can be delivered to algae cells. Electroporation protocol follows standard recommended protocol from the GeneArt *Chlamydomonas* Engineering kit.

Particular Applications of the RNA Targeting Enzymes in Plants

In particular embodiments, present invention can be used as a therapy for virus removal in plant systems as it is able to cleave viral RNA. Previous studies in human systems have demonstrated the success of utilizing CRISPR in targeting the single strand RNA virus, hepatitis C (A. Price, et al., Proc. Natl. Acad. Sci, 2015). These methods may also be adapted for using the RNA targeting CRISPR system in plants.

Improved Plants

The present invention also provides plants and yeast cells obtainable and obtained by the methods provided herein. The improved plants obtained by the methods described herein may be useful in food or feed production through the modified expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

In an embodiment of the invention, a C2c2 system is used to engineer pathogen resistant plants, for example by creating resistance against diseases caused by bacteria, fungi or viruses. In certain embodiments, pathogen resistance can be accomplished by engineering crops to produce a C2c2 system that wil be ingested by an insect pest, leading to mortality. In an embodiment of the invention, a C2c2 system is used to engineer abiotic stress tolerance. In another embodiment, a C2c2 system is used to engineer drought stress tolerance or salt stress tolerance, or cold or heat stress tolerance. Younis et al. 2014, Int. J. Biol. Sci. 10; 1150 reviewed potential targets of plant breeding methods, all of which are amenable to correction or improvement through use of a C2c2 system described herein. Some non-limiting target crops include Arabidops *Zea mays* is *thaliana, Oryza sativa* L, *Prunus domestica* L., *Gossypium hirsutum, Nicotiana rustica, Zea mays, Medicago sativa, Nicotiana benthamiana* and *Arabidopsis thaliana*

In an embodiment of the invention, a C2c2 system is used for management of crop pests. For example, a C2c2 system operable in a crop pest can be expressed from a plant host or transferred directly to the target, for example using a viral vector.

In an embodiment, the invention provides a method of efficiently producing homozygous organisms from a heterozygous non-human starting organism. In an embodiment, the invention is used in plant breeding. In another embodiment, the invention is used in animal breeding. In such embodiments, a homozygous organism such as a plant or animal is made by preventing or suppressing recombination by interfering with at least one target gene involved in double strand breaks, chromosome pairing and/or strand exchange.

Application of the C2C2 Proteins in Optimized Functional RNA Targeting Systems

In an aspect the invention provides a system for specific delivery of functional components to the RNA environment. This can be ensured using the CRISPR systems comprising the RNA targeting effector proteins of the present invention which allow specific targeting of different components to RNA. More particularly such components include activators or repressors, such as activators or repressors of RNA translation, degradation, etc. Applications of this system are described elsewhere herein.

According to one aspect the invention provides non-naturally occurring or engineered composition comprising a guide RNA comprising a guide sequence capable of hybridizing to a target sequence in a genomic locus of interest in a cell, wherein the guide RNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. The guide RNAs of the c2c2 enzymes described herein are shown to be amenable to modification of the guide sequence. In particular embodiments, the guide RNA is modified by the insertion of distinct RNA sequence(s) 5' of the direct repeat, within the direct repeat, or 3' of the guide sequence. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function; In an aspect the invention provides a herein-discussed composition, wherein the composition comprises a CRISPR-Cas complex having at least three functional domains, at least one of which is associated with the RNA targeting enzyme and at least two of which are associated with the gRNA.

Accordingly, in an aspect the invention provides non-naturally occurring or engineered CRISPR-Cas complex composition comprising the guide RNA as herein-discussed and a CRISPR enzyme which is an RNA targeting enzyme, wherein optionally the RNA targeting enzyme comprises at least one mutation, such that the RNA targeting enzyme has no more than 5% of the nuclease activity of the enzyme not having the at least one mutation, and optionally one or more comprising at least one or more nuclear localization sequences. In particular embodiments, the guide RNA is additionally or alternatively modified so as to still ensure binding of the RNA targeting enzyme but to prevent cleavage by the RNA targeting enzyme (as detailed elsewhere herein).

In particular embodiments, the RNA targeting enzyme is a c2c2 enzyme which has a diminished nuclease activity of at least 97%, or 100% as compared with the c2c2 enzyme not having the at least one mutation. In an aspect the invention provides a herein-discussed composition, wherein the C2c2 enzyme comprises two or more mutations. The mutations may be selected from mutations of one or more of the following amino acid residues: R597, H602, R1278, and H1283, such as for instance one or more of the following mutations: R597A, H602A, R1278A, and H1283A, according to *Leptotrichia shahii* c2c2 protein or a corresponding position in an ortholog.

In particular embodiments, an RNA targeting system is provided as described herein above comprising two or more functional domains. In particular embodiments, the two or more functional domains are heterologous functional domain. In particular embodiments, the system comprises an adaptor protein which is a fusion protein comprising a functional domain, the fusion protein optionally comprising a linker between the adaptor protein and the functional domain. In particular embodiments, the linker includes a GlySer linker. Additionally or alternatively, one or more functional domains are attached to the RNA effector protein by way of a linker, optionally a GlySer linker. In particular embodiments, the one or more functional domains are attached to the RNA targeting enzyme through one or both of the HEPN domains.

In an aspect the invention provides a herein-discussed composition, wherein the one or more functional domains associated with the adaptor protein or the RNA targeting enzyme is a domain capable of activating or repressing RNA translation. In an aspect the invention provides a herein-discussed composition, wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity, or molecular switch activity or chemical inducibility or light inducibility.

In an aspect the invention provides a herein-discussed composition comprising an aptamer sequence. In particular embodiments, the aptamer sequence is two or more aptamer sequences specific to the same adaptor protein. In an aspect the invention provides a herein-discussed composition, wherein the aptamer sequence is two or more aptamer sequences specific to different adaptor protein. In an aspect the invention provides a herein-discussed composition, wherein the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. Accordingly, in particular embodiments, the aptamer is selected from a binding protein specifically binding any one of the adaptor proteins listed above. In an aspect the invention provides a herein-discussed composition, wherein the cell is a eukaryotic cell. In an aspect the invention provides a herein-discussed composition, wherein the eukaryotic cell is a mammalian cell, a plant cell or a yeast cell, whereby the mammalian cell is optionally a mouse cell. In an aspect the invention provides a herein-discussed composition, wherein the mammalian cell is a human cell.

In an aspect the invention provides a herein above-discussed composition wherein there is more than one gRNA, and the gRNAs target different sequences whereby when the composition is employed, there is multiplexing. In an aspect the invention provides a composition wherein there is more than one gRNA modified by the insertion of distinct RNA sequence(s) that bind to one or more adaptor proteins.

In an aspect the invention provides a herein-discussed composition wherein one or more adaptor proteins associated with one or more functional domains is present and bound to the distinct RNA sequence(s) inserted into the guide RNA(s).

In an aspect the invention provides a herein-discussed composition wherein the guide RNA is modified to have at least one non-coding functional loop; e.g., wherein the at least one non-coding functional loop is repressive; for instance, wherein at least one non-coding functional loop comprises Alu.

In an aspect the invention provides a method for modifying gene expression comprising the administration to a host or expression in a host in vivo of one or more of the compositions as herein-discussed.

In an aspect the invention provides a herein-discussed method comprising the delivery of the composition or nucleic acid molecule(s) coding therefor, wherein said nucleic acid molecule(s) are operatively linked to regulatory sequence(s) and expressed in vivo. In an aspect the invention provides a herein-discussed method wherein the expression in vivo is via a lentivirus, an adenovirus, or an AAV.

In an aspect the invention provides a mammalian cell line of cells as herein-discussed, wherein the cell line is, optionally, a human cell line or a mouse cell line. In an aspect the invention provides a transgenic mammalian model, optionally a mouse, wherein the model has been transformed with a herein-discussed composition or is a progeny of said transformant.

In an aspect the invention provides a nucleic acid molecule(s) encoding guide RNA or the RNA targeting CRISPR-Cas complex or the composition as herein-discussed. In an aspect the invention provides a vector comprising: a nucleic acid molecule encoding a guide RNA (gRNA) comprising a guide sequence capable of hybridizing to a target sequence in a genomic locus of interest in a cell, wherein the direct repeat of the gRNA is modified by the insertion of distinct RNA sequence(s) that bind(s) to two or more adaptor proteins, and wherein each adaptor protein is associated with one or more functional domains; or, wherein the gRNA is modified to have at least one non-coding functional loop. In an aspect the invention provides vector(s) comprising nucleic acid molecule(s) encoding: non-naturally occurring or engineered CRISPR-Cas complex composition comprising the gRNA herein-discussed, and an RNA targeting enzyme, wherein optionally the RNA targeting enzyme comprises at least one mutation, such that the RNA targeting enzyme has no more than 5% of the nuclease activity of the RNA targeting enzyme not having the at least one mutation, and optionally one or more comprising at least one or more nuclear localization sequences. In an aspect a vector can further comprise regulatory element(s) operable in a eukaryotic cell operably linked to the nucleic acid molecule encoding the guide RNA (gRNA) and/or the nucleic acid molecule encoding the RNA targeting enzyme and/or the optional nuclear localization sequence(s).

In one aspect, the invention provides a kit comprising one or more of the components described hereinabove. In some embodiments, the kit comprises a vector system as described above and instructions for using the kit.

In an aspect the invention provides a method of screening for gain of function (GOF) or loss of function (LOF) or for screening non-coding RNAs or potential regulatory regions (e.g. enhancers, repressors) comprising the cell line of as herein-discussed or cells of the model herein-discussed containing or expressing the RNA targeting enzyme and introducing a composition as herein-discussed into cells of the cell line or model, whereby the gRNA includes either an activator or a repressor, and monitoring for GOF or LOF respectively as to those cells as to which the introduced gRNA includes an activator or as to those cells as to which the introduced gRNA includes a repressor.

In an aspect the invention provides a library of non-naturally occurring or engineered compositions, each comprising a RNA targeting CRISPR guide RNA (gRNA) comprising a guide sequence capable of hybridizing to a target RNA sequence of interest in a cell, an RNA targeting enzyme, wherein the RNA targeting enzyme comprises at least one mutation, such that the RNA targeting enzyme has no more than 5% of the nuclease activity of the RNA targeting enzyme not having the at least one mutation, wherein the gRNA is modified by the insertion of distinct RNA sequence(s) that bind to one or more adaptor proteins, and wherein the adaptor protein is associated with one or more functional domains, wherein the composition comprises one or two or more adaptor proteins, wherein the each protein is associated with one or more functional domains, and wherein the gRNAs comprise a genome wide library comprising a plurality of RNA targeting guide RNAs (gRNAs). In an aspect the invention provides a library as herein-discussed, wherein the RNA targeting RNA targeting enzyme has a diminished nuclease activity of at least 97%, or 100% as compare with the RNA targeting enzyme not having the at least one mutation. In an aspect the invention provides a library as herein-discussed, wherein the adaptor protein is a fusion protein comprising the functional domain. In an aspect the invention provides a library as herein discussed, wherein the gRNA is not modified by the insertion of distinct RNA sequence(s) that bind to the one or two or more adaptor proteins. In an aspect the invention provides a library as herein discussed, wherein the one or two or more functional domains are associated with the RNA targeting enzyme. In an aspect the invention provides a library as herein discussed, wherein the cell population of cells is a population of eukaryotic cells. In an aspect the invention provides a library as herein discussed, wherein the eukaryotic cell is a mammalian cell, a plant cell or a yeast cell. In an aspect the invention provides a library as herein discussed, wherein the mammalian cell is a human cell. In an aspect the invention provides a library as herein discussed, wherein the population of cells is a population of embryonic stem (ES) cells.

In an aspect the invention provides a library as herein discussed, wherein the targeting is of about 100 or more RNA sequences. In an aspect the invention provides a library as herein discussed, wherein the targeting is of about 1000 or more RNA sequences. In an aspect the invention provides a library as herein discussed, wherein the targeting is of about 20,000 or more sequences. In an aspect the invention provides a library as herein discussed, wherein the targeting is of the entire transcriptome. In an aspect the invention provides a library as herein discussed, wherein the targeting is of a panel of target sequences focused on a relevant or desirable pathway. In an aspect the invention provides a library as herein discussed, wherein the pathway is an immune pathway. In an aspect the invention provides a library as herein discussed, wherein the pathway is a cell division pathway.

In one aspect, the invention provides a method of generating a model eukaryotic cell comprising a gene with modified expression. In some embodiments, a disease gene is any gene associated an increase in the risk of having or developing a disease. In some embodiments, the method comprises (a) introducing one or more vectors encoding the components of the system described herein above into a eukaryotic cell, and (b) allowing a CRISPR complex to bind to a target polynucleotide so as to modify expression of a gene, thereby generating a model eukaryotic cell comprising modified gene expression.

The structural information provided herein allows for interrogation of guide RNA interaction with the target RNA and the RNA targeting enzyme permitting engineering or alteration of guide RNA structure to optimize functionality of the entire RNA targeting CRISPR-Cas system. For example, the guide RNA may be extended, without colliding with the RNA targeting protein by the insertion of adaptor proteins that can bind to RNA. These adaptor proteins can further recruit effector proteins or fusions which comprise one or more functional domains.

An aspect of the invention is that the above elements are comprised in a single composition or comprised in individual compositions. These compositions may advantageously be applied to a host to elicit a functional effect on the genomic level.

The skilled person will understand that modifications to the guide RNA which allow for binding of the adapter+ functional domain but not proper positioning of the adapter+ functional domain (e.g. due to steric hindrance within the three dimensional structure of the CRISPR complex) are modifications which are not intended. The one or more modified guide RNA may be modified, by introduction of a distinct RNA sequence(s) 5' of the direct repeat, within the direct repeat, or 3' of the guide sequence.

The modified guide RNA, the inactivated RNA targeting enzyme (with or without functional domains), and the binding protein with one or more functional domains, may each individually be comprised in a composition and administered to a host individually or collectively. Alternatively, these components may be provided in a single composition for administration to a host. Administration to a host may be performed via viral vectors known to the skilled person or described herein for delivery to a host (e.g. lentiviral vector, adenoviral vector, AAV vector). As explained herein, use of different selection markers (e.g. for lentiviral gRNA selection) and concentration of gRNA (e.g. dependent on whether multiple gRNAs are used) may be advantageous for eliciting an improved effect.

Using the provided compositions, the person skilled in the art can advantageously and specifically target single or multiple loci with the same or different functional domains to elicit one or more genomic events. The compositions may be applied in a wide variety of methods for screening in libraries in cells and functional modeling in vivo (e.g. gene activation of lincRNA and indentification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR RNA targeting events. (See, e.g., Platt et al., Cell (2014), DOI:10.1016/j.cell.2014.09.014, or PCT patent publications cited herein, such as WO 2014/093622 (PCT/US2013/074667), which are not believed prior to the present invention or application). For example, the target cell comprises RNA targeting CRISRP enzyme conditionally or inducibly (e.g. in the form of Cre dependent constructs) and/or the adapter protein conditionally or inducibly and, on expression of a vector introduced into the target cell, the vector expresses that which induces or gives rise to the condition of s RNA targeting enzyme expression and/or adaptor expression in the target cell. By applying the teaching and compositions of the current invention with the known method of creating a CRISPR complex, inducible gene expression affected by functional domains are also an aspect of the current invention. Alternatively, the adaptor protein may be provided as a conditional or inducible element with a conditional or inducible s RNA targeting enzyme to provide an effective model for screening purposes, which advantageously only requires minimal design and administration of specific gRNAs for a broad number of applications.

Guide RNA According to the Invention Comprising a Dead Guide Sequence

In one aspect, the invention provides guide sequences which are modified in a manner which allows for formation of the CRISPR complex and successful binding to the target, while at the same time, not allowing for successful nuclease activity (i.e. without nuclease activity/without indel activity). For matters of explanation such modified guide sequences are referred to as "dead guides" or "dead guide sequences". These dead guides or dead guide sequences can be thought of as catalytically inactive or conformationally inactive with regard to nuclease activity. Indeed, dead guide sequences may not sufficiently engage in productive base pairing with respect to the ability to promote catalytic activity or to distinguish on-target and off-target binding activity. Briefly, the assay involves synthesizing a CRISPR target RNA and guide RNAs comprising mismatches with the target RNA, combining these with the RNA targeting enzyme and analyzing cleavage based on gels based on the presence of bands generated by cleavage products, and quantifying cleavage based upon relative band intensities.

Hence, in a related aspect, the invention provides a non-naturally occurring or engineered composition RNA targeting CRISPR-Cas system comprising a functional RNA targeting as described herein, and guide RNA (gRNA) wherein the gRNA comprises a dead guide sequence whereby the gRNA is capable of hybridizing to a target sequence such that the RNA targeting CRISPR-Cas system is directed to a genomic locus of interest in a cell without detectable RNA cleavage activity of a non-mutant RNA targeting enzyme of the system. It is to be understood that any of the gRNAs according to the invention as described herein elsewhere may be used as dead gRNAs/gRNAs comprising a dead guide sequence as described herein below. Any of the methods, products, compositions and uses as described herein elsewhere is equally applicable with the dead gRNAs/gRNAs comprising a dead guide sequence as further detailed below. By means of further guidance, the following particular aspects and embodiments are provided.

The ability of a dead guide sequence to direct sequence-specific binding of a CRISPR complex to an RNA target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence. For instance, cleavage of a target RNA polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within a genome of a cell.

As explained further herein, several structural parameters allow for a proper framework to arrive at such dead guides. Dead guide sequences are typically shorter than respective guide sequences which result in active RNA cleavage. In particular embodiments, dead guides are 5%, 10%, 20%, 30%, 40%, 50%, shorter than respective guides directed to the same.

As explained below and known in the art, one aspect of gRNA-RNA targeting specificity is the direct repeat sequence, which is to be appropriately linked to such guides. In particular, this implies that the direct repeat sequences are designed dependent on the origin of the RNA targeting enzyme. Thus, structural data available for validated dead guide sequences may be used for designing C2c2 specific equivalents. Structural similarity between, e.g., the orthologous nuclease domains HEPN of two or more C2c2 effector proteins may be used to transfer design equivalent dead guides. Thus, the dead guide herein may be appropriately modified in length and sequence to reflect such C2c2 specific equivalents, allowing for formation of the CRISPR complex and successful binding to the target RNA, while at the same time, not allowing for successful nuclease activity.

The use of dead guides in the context herein as well as the state of the art provides a surprising and unexpected platform for network biology and/or systems biology in both in vitro, ex vivo, and in vivo applications, allowing for multiplex gene targeting, and in particular bidirectional multiplex gene targeting. Prior to the use of dead guides, addressing multiple targets has been challenging and in some cases not possible. With the use of dead guides, multiple targets, and thus multiple activities, may be addressed, for example, in the same cell, in the same animal, or in the same patient. Such multiplexing may occur at the same time or staggered for a desired timeframe.

For example, the dead guides allow to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble multiple distinct effector domains. Such may be modeled after natural processes.

Thus, one aspect is a gRNA of the invention which comprises a dead guide, wherein the gRNA further comprises modifications which provide for gene activation or repression, as described herein. The dead gRNA may comprise one or more aptamers. The aptamers may be specific to gene effectors, gene activators or gene repressors. Alternatively, the aptamers may be specific to a protein which in turn is specific to and recruits/binds a specific gene effector, gene activator or gene repressor. If there are multiple sites for activator or repressor recruitment, it is preferred that the sites are specific to either activators or repressors. If there are multiple sites for activator or repressor binding, the sites may be specific to the same activators or same repressors. The sites may also be specific to different activators or different repressors. The effectors, activators, repressors may be present in the form of fusion proteins.

In an aspect, the invention provides a method of selecting a dead guide RNA targeting sequence for directing a functionalized CRISPR system to a gene locus in an organism, which comprises: a) locating one or more CRISPR motifs in the gene locus; b) analyzing the 20 nt sequence downstream of each CRISPR motif by: i) determining the GC content of the sequence; and ii) determining whether there are off-target matches of the first 15 nt of the sequence in the genome of the organism; c) selecting the sequence for use in a guide RNA if the GC content of the sequence is 70% or less and no off-target matches are identified. In an embodiment, the sequence is selected if the GC content is 50% or less. In an embodiment, the sequence is selected if the GC content is 40% or less. In an embodiment, the sequence is selected if the GC content is 30% or less. In an embodiment, two or more sequences are analyzed and the sequence having the lowest GC content is selected. In an embodiment, off-target matches are determined in regulatory sequences of the organism. In an embodiment, the gene locus is a regulatory region. An aspect provides a dead guide RNA comprising the targeting sequence selected according to the aforementioned methods.

In an aspect, the invention provides a dead guide RNA for targeting a functionalized CRISPR system to a gene locus in an organism. In an embodiment of the invention, the dead guide RNA comprises a targeting sequence wherein the CG content of the target sequence is 70% or less, and the first 15 nt of the targeting sequence does not match an off-target sequence downstream from a CRISPR motif in the regulatory sequence of another gene locus in the organism. In certain embodiments, the GC content of the targeting sequence 60% or less, 55% or less, 50% or less, 45% or less, 40% or less, 35% or less or 30% or less. In certain embodiments, the GC content of the targeting sequence is from 70% to 60% or from 60% to 50% or from 50% to 40% or from 40% to 30%. In an embodiment, the targeting sequence has the lowest CG content among potential targeting sequences of the locus.

In an embodiment of the invention, the first 15 nt of the dead guide match the target sequence. In another embodiment, first 14 nt of the dead guide match the target sequence. In another embodiment, the first 13 nt of the dead guide match the target sequence. In another embodiment first 12 nt of the dead guide match the target sequence. In another embodiment, first 11 nt of the dead guide match the target sequence. In another embodiment, the first 10 nt of the dead guide match the target sequence. In an embodiment of the invention the first 15 nt of the dead guide does not match an off-target sequence downstream from a CRISPR motif in the regulatory region of another gene locus. In other embodiments, the first 14 nt, or the first 13 nt of the dead guide, or the first 12 nt of the guide, or the first 11 nt of the dead guide, or the first 10 nt of the dead guide, does not match an off-target sequence downstream from a CRISPR motif in the regulatory region of another gene locus. In other embodiments, the first 15 nt, or 14 nt, or 13 nt, or 12 nt, or 11 nt of the dead guide do not match an off-target sequence downstream from a CRISPR motif in the genome.

In certain embodiments, the dead guide RNA includes additional nucleotides at the 3'-end that do not match the target sequence. Thus, a dead guide RNA that includes the first 20-28 nt, downstream of a CRISPR motif can be extended in length at the 3' end.

General Provisions

In an aspect, the invention provides a nucleic acid binding system. In situ hybridization of RNA with complementary probes is a powerful technique. Typically fluorescent DNA oligonucleotides are used to detect nucleic acids by hybridization. Increased efficiency has been attained by certain modifications, such as locked nucleic acids (LNAs), but there remains a need for efficient and versatile alternatives. The invention provides an efficient and adaptable system for in situ hybridization.

In embodiments of the invention the terms guide sequence and guide RNA are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at novocraft.com), ELAND (Illumina, San Diego, Calif.), SOAP (available at soap.genomics.org), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence may be selected to target any target sequence. In some embodiments, the target sequence is a sequence within a genome of a cell. Exemplary target sequences include those that are unique in the target genome.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the P-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit P-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

Advantageous vectors include lentiviruses and adeno-associated viruses, and types of such vectors can also be selected for targeting particular types of cells.

As used herein, the term "crRNA" or "guide RNA" or "single guide RNA" or "sgRNA" or "one or more nucleic acid components" of a Type V or Type VI CRISPR-Cas locus effector protein comprises any polynucleotide sequence having sufficient complementarity with a target nucleic acid sequence to hybridize with the target nucleic acid sequence and direct sequence-specific binding of a nucleic acid-targeting complex to the target nucleic acid sequence. In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at novocraft.com), ELAND (Illumina, San Diego, Calif.), SOAP (available at genomics.org), and Maq (available at sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide RNA may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomaal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide RNA is selected to reduce the degree secondary structure within the RNA-targeting guide RNA. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R Gruber et al., 2008, Cell 106(1): 23-24; and P A Carr and G M Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides, preferably at least 18 nt, such at at least 19, 20, 21, 22, or more nt. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

Applicants also perform a challenge experiment to verify the DNA targeting and cleaving capability of a Type V protein such as C2c1 or C2c3. This experiment closely parallels similar work in E. coli for the heterologous expression of StCas9 (Sapranauskas, R. et al. Nucleic Acids Res 39, 9275-9282 (2011)). Applicants introduce a plasmid containing both a PAM and a resistance gene into the heterologous E. coli, and then plate on the corresponding antibiotic. If there is DNA cleavage of the plasmid, Applicants observe no viable colonies.

In further detail, the assay is as follows for a DNA target. Two E. coli strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the DNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12h after transformation, all colonies formed by the test and control strains where harvested and plasmid DNA was isolated. Plasmid DNA was used as template for PCR amplification and subsequent deep sequencing. Representation of all PAMs in the untransformed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM.

For minimization of toxicity and off-target effect, it will be important to control the concentration of nucleic acid-targeting guide RNA delivered. Optimal concentrations of nucleic acid-targeting guide RNA can be determined by testing different concentrations in a cellular or non-human eukaryote animal model and using deep sequencing the analyze the extent of modification at potential off-target genomic loci. The concentration that gives the highest level of on-target modification while minimizing the level of off-target modification should be chosen for in vivo delivery. The nucleic acid-targeting system is derived advantageously from a Type VI CRISPR system. In some embodiments, one or more elements of a nucleic acid-targeting system is derived from a particular organism comprising an endogenous RNA-targeting system. In particular embodiments, the Type VI RNA-targeting Cas enzyme is C2c2. Non-limiting examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmrl, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof. In embodiments, the Type VI protein such as C2c2 as referred to herein also encompasses a homologue or an orthologue of a Type VI protein such as C2c2. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related. In particular embodiments, the homologue or orthologue of a Type VI protein such as C2c2 as referred to herein has a sequence homology or identity of at least 80%, more preferably at least 85%, even more preferably at least 90%, such as for instance at least 95% with a Type VI protein such as C2c2. In further embodiments, the homologue or orthologue of a Type VI protein such as C2c2 as referred to herein has a sequence identity of at least 80%, more preferably at least 85%, even more preferably at least 90%, such as for instance at least 95% with the wild type Type VI protein such as C2c2.

In an embodiment, the Type VI RNA-targeting Cas protein may be a C2c2 ortholog of an organism of a genus which includes but is not limited to *Corynebacter, Sutterella, Legionella, Treponema, Filifactor, Eubacterium, Streptococcus, Lactobacillus, Mycoplasma Bacteroides, Flaviivola, Flavobacterium, Sphaerochaeta, Azospirillum, Gluconacetobacter, Neisseria Roseburia Parvibaculum, Staphylococcus, Nitraifractor, Mycoplasma* and *Campylobacter*. Species of organism of such a genus can be as otherwise herein discussed.

Some methods of identifying orthologs of CRISPR-Cas system enzymes may involve identifying tracr sequences in genomes of interest. Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to *Corynebacter, Sutterella Legionell, Treponema Fiifactor, Eubacterium, Streptococcus, Lactobacillus, Mycoplasma Bacteroides, Flaviivola Flavobacterium, Sphaerochaeta, Azospirillum, Gluconacetobacter, Neisseria Roseburia Parvibaculum, Staphylococcus, Nitratifractor, Mycoplasma* and *Campylobacter*. A chimeric enzyme can comprise a first fragment and a second fragment, and the fragments can be of CRISPR enzyme orthologs of organisms of genuses herein mentioned or of species herein mentioned; advantageously the fragments are from CRISPR enzyme orthologs of different species.

In embodiments, the Type VI RNA-targeting effector protein, in particular the C2c2 protein as referred to herein also encompasses a functional variant of C2c2 or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be man-made. Advantageous embodiments can involve engineered or non-naturally occurring Type VI RNA-targeting effector protein, e.g., C2c1/C2c3 or an ortholog or homolog thereof.

In an embodiment, nucleic acid molecule(s) encoding the Type VI RNA-targeting effector protein, in particular C2c2 or an ortholog or homolog thereof, may be codon-optimized for expression in an eukaryotic cell. A eukaryote can be as herein discussed. Nucleic acid molecule(s) can be engineered or non-naturally occurring.

In an embodiment, the Type VI RNA-targeting effector protein, in particular C2c2 or an ortholog or homolog thereof, may comprise one or more mutations (and hence nucleic acid molecule(s) coding for same may have mutation(s). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains.

In an embodiment, the Type VI protein such as C2c2 or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to RuvC I, RuvC II, RuvC III, HNH domains, and HEPN domains.

In an embodiment, the Type VI protein such as C2c2 or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In some embodiments, the unmodified nucleic acid-targeting effector protein may have cleavage activity. In some embodiments, the RNA-targeting effector protein may direct cleavage of one or both nucleic acid (DNA or RNA) strands at the location of or near a target sequence, such as within the target sequence and/or within the complement of the target sequence or at sequences associated with the target sequence. In some embodiments, the nucleic acid-targeting Cas protein may direct cleavage of one or both DNA or RNA strands within about 1, 2, 3, 4, 5, 6, 7, 8, 9, 10, 15, 20, 25, 50, 100, 200, 500, or more base pairs from the first or last nucleotide of a target sequence. In some embodiments, the cleavage may be blunt, i.e., generating blunt ends. In some embodiments, the cleavage may be staggered, i.e., generating sticky ends. In some embodiments, the cleavage may be a staggered cut with a 5' overhang, e.g., a 5' overhang of 1 to 5 nucleotides. In some embodiments, the cleavage may be a staggered cut with a 3' overhang, e.g., a 3' overhang of 1 to 5 nucleotides. In some embodiments, a vector encodes a nucleic acid-targeting Cas protein that may be mutated with respect to a corresponding wild-type enzyme such that the mutated nucleic acid-targeting Cas protein lacks the ability to cleave one or both DNA or RNA strands of a target polynucleotide containing a target sequence. As a further example, two or more catalytic domains of Cas (RuvC I, RuvC I, and RuvC III or the HNH domain, or HEPN domain) may be mutated to produce a mutated Cas substantially lacking all RNA cleavage activity. As described herein, corresponding catalytic domains of a C2c2 effector protein may also be mutated to produce a mutated C2c2 effector protein lacking all DNA cleavage activity or having substantially reduced DNA cleavage activity. In some embodiments, a nucleic acid-targeting effector protein may be considered to substantially lack all RNA cleavage activity when the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. An effector protein may be identified with reference to the general class of enzymes that share homology to the biggest nuclease with multiple nuclease domains from the Type V/Type VI CRISPR system. Most preferably, the effector protein is a Type V/Type VI protein such as C2c2. By derived, Applicants mean that the derived enzyme is largely based, in the sense of having a high degree of sequence homology with, a wildtype enzyme, but that it has been mutated (modified) in some way as known in the art or as described herein.

Again, it will be appreciated that the terms Cas and CRISPR enzyme and CRISPR protein and Cas protein are generally used interchangeably and at all points of reference herein refer by analogy to novel CRISPR effector proteins further described in this application, unless otherwise apparent, such as by specific reference to Cas9. As mentioned above, many of the residue numberings used herein refer to the effector proteinfrom the Type V/Type VI CRISPR locus. However, it will be appreciated that this invention includes many more effector proteinsfrom other species of microbes. In certain embodiments, Cas may be constitutively present or inducibly present or conditionally present or administered or delivered. Cas optimization may be used to enhance function or to develop new functions, one can generate chimeric Cas proteins. And Cas may be used as a generic nucleic acid binding protein.

Typically, in the context of an endogenous nucleic acid-targeting system, formation of a nucleic acid-targeting complex (comprising a guide RNA hybridized to a target sequence and complexed with one or more nucleic acid-targeting effector proteins) results in cleavage of one or both DNA or RNA strands in or near (e.g., within 1, 2, 3, 4, 5, 6, 7, 8, 9, 10, 20, 50, or more base pairs from) the target sequence. As used herein the term "sequence(s) associated with a target locus of interest" refers to sequences near the vicinity of the target sequence (e.g. within 1, 2, 3, 4, 5, 6, 7, 8, 9, 10, 20, 50, or more base pairs from the target sequence, wherein the target sequence is comprised within a target locus of interest).

An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/UJS2013/074667) as an example of a codon optimized sequence (from knowledge in the art and this disclosure, codon optimizing coding nucleic acid molecule(s), especially as to effector protein (e.g., C2c2) is within the ambit of the skilled artisan). Whilst this is preferred, it will be appreciated that other examples are possible and codon optimization for a host species other than human, or for codon optimization for specific organs is known. In some embodiments, an enzyme coding sequence encoding a DNA/RNA-targeting Cas protein is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid.

In some embodiments, a vector encodes a nucleic acid-targeting effector protein such as the Type V RNA-targeting effector protein, in particular C2c2, or an ortholog or homolog thereof comprising one or more nuclear localization sequences (NLSs), such as about or more than about 1, 2, 3, 4, 5, 6, 7, 8, 9, 10, or more NLSs. In some embodiments, the RNA-targeting effector protein comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV; the NLS from nucleoplasmin (e.g., the nucleoplasmin bipartite NLS with the sequence KRPAATKKAGQAKKKK); the c-myc NLS having the amino acid sequence PAAKRVKLD or RQRRNELKRSP; the hRNPA1 M9 NLS having the sequence NQSSNFGPMKGGNFGGRSSGPYGGGGQYFAK-PRNQGGY; the sequence RMRIZFKNKGKDTAEL-RRRRVEVSVELRKAKKDEQILKRRNV of the IBB domain from importin-alpha; the sequences VSRKRPRP and PPKKARED of the myoma T protein; the sequence POPKKKPL of human p53; the sequence SALIKKKKK-MAP of mouse c-abl IV; the sequences DRLRR and PKQKKRK of the influenza virus NS1; the sequence RKLKKKIKKL of the Hepatitis virus delta antigen; the sequence REKKKFLKRR of the mouse Mx1 protein; the sequence KRKGDEVDGVDEVAKKKSKK of the human poly(ADP-ribose) polymerase; and the sequence RKCLQAGMNLEARKTKK of the steroid hormone receptors (human) glucocorticoid. In general, the one or more NLSs are of sufficient strength to drive accumulation of the DNA/RNA-targeting Cas protein in a detectable amount in the nucleus of a eukaryotic cell. In general, strength of nuclear localization activity may derive from the number of NLSs in the nucleic acid-targeting effector protein, the particular NLS(s) used, or a combination of these factors. Detection of accumulation in the nucleus may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of nucleic acid-targeting complex formation (e.g., assay for DNA or RNA cleavage or mutation at the target sequence, or assay for altered gene expression activity affected by DNA or RNA-targeting complex formation and/or DNA or RNA-targeting Cas protein activity), as compared to a control not exposed to the nucleic acid-targeting Cas protein or nucleic acid-targeting complex, or exposed to a nucleic acid-targeting Cas protein lacking the one or more NLSs. In preferred embodiments of the herein described C2c2 effector protein complexes and systems the codon optimized C2c2 effector proteins comprise an NLS attached to the C-terminal of the protein.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA could each be operably linked to separate regulatory elements on separate vectors. RNA(s) of the nucleic acid-targeting system can be delivered to a transgenic nucleic acid-targeting effector protein animal or mammal, e.g., an animal or mammal that constitutively or inducibly or conditionally expresses nucleic acid-targeting effector protein; or an animal or mammal that is otherwise expressing nucleic acid-targeting effector protein or has cells containing nucleic acid-targeting effector protein, such as by way of prior administration thereto of a vector or vectors that code for and express in vivo nucleic acid-targeting effector protein. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, nanoparticles, formulations and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. In some embodiments, a vector comprises two or more insertion sites, so as to allow insertion of a guide sequence at each site. In such an arrangement, the two or more guide sequences may comprise two or more copies of a single guide sequence, two or more different guide sequences, or combinations of these. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a a nucleic acid-targeting effector protein. nucleic acid-targeting effector protein or nucleic acid-targeting guide RNA or RNA(s) can be delivered separately; and advantageously at least one of these is delivered via a particle or nanoparticle complex. nucleic acid-targeting effector protein mRNA can be delivered prior to the nucleic acid-targeting guide RNA to give time for nucleic acid-targeting effector protein to be expressed. nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+guide RNA. Additional administrations of nucleic acid-targeting effector protein mRNA and/or guide RNA might be useful to achieve the most efficient levels of genome and/or transcriptome modification.

In one aspect, the invention provides methods for using one or more elements of a nucleic acid-targeting system. The nucleic acid-targeting complex of the invention provides an effective means for modifying a target DNA or RNA single or double stranded, linear or super-coiled. The nucleic acid-targeting complex of the invention has a wide variety of utility including modifying (e.g., deleting, inserting, translocating, inactivating, activating) a target DNA or RNA in a multiplicity of cell types. As such the nucleic acid-targeting complex of the invention has a broad spectrum of applications in, e.g., gene therapy, drug screening, disease diagnosis, and prognosis. An exemplary nucleic acid-targeting complex comprises a DNA or RNA-targeting effector protein complexed with a guide RNA hybridized to a target sequence within the target locus of interest.

In one embodiment, this invention provides a method of cleaving a target RNA. The method may comprise modifying a target RNA using a nucleic acid-targeting complex that binds to the target RNA and effect cleavage of said target RNA. In an embodiment, the nucleic acid-targeting complex of the invention, when introduced into a cell, may create a break (e.g., a single or a double strand break) in the RNA sequence. For example, the method can be used to cleave a disease RNA in a cell. For example, an exogenous RNA template comprising a sequence to be integrated flanked by an upstream sequence and a downstream sequence may be introduced into a cell. The upstream and downstream sequences share sequence similarity with either side of the site of integration in the RNA. Where desired, a donor RNA can be mRNA. The exogenous RNA template comprises a sequence to be integrated (e.g., a mutated RNA). The sequence for integration may be a sequence endogenous or exogenous to the cell. Examples of a sequence to be integrated include RNA encoding a protein or a non-coding RNA (e.g., a microRNA). Thus, the sequence for integration may be operably linked to an appropriate control sequence or sequences. Alternatively, the sequence to be integrated may provide a regulatory function. The upstream and downstream sequences in the exogenous RNA template are selected to promote recombination between the RNA sequence of interest and the donor RNA. The upstream sequence is a RNA sequence that shares sequence similarity with the RNA sequence upstream of the targeted site for integration. Similarly, the downstream sequence is a RNA sequence that shares sequence similarity with the RNA sequence downstream of the targeted site of integration. The upstream and downstream sequences in the exogenous RNA template can have 75%, 80%/%, 85%, 90%, 95%, or 100% sequence identity with the targeted RNA sequence. Preferably, the upstream and downstream sequences in the exogenous RNA template have about 95%, 96%, 97%, 98%, 99%, or 100% sequence identity with the targeted RNA sequence. In some methods, the upstream and downstream sequences in the exogenous RNA template have about 99% or 100% sequence identity with the targeted RNA sequence. An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp. In some methods, the exogenous RNA template may further comprise a marker. Such a marker may make it easy to screen for targeted integrations. Examples of suitable markers include restriction sites, fluorescent proteins, or selectable markers. The exogenous RNA template of the invention can be constructed using recombinant techniques (see, for example, Sambrook et al., 2001 and Ausubel et al., 1996). In a method for modifying a target RNA by integrating an exogenous RNA template, a break (e.g., double or single stranded break in double or single stranded DNA or RNA) is introduced into the DNA or RNA sequence by the nucleic acid-targeting complex, the break is repaired via homologous recombination with an exogenous RNA template such that the template is integrated into the RNA target. The presence of a double-stranded break facilitates integration of the template. In other embodiments, this invention provides a method of modifying expression of a RNA in a eukaryotic cell. The method comprises increasing or decreasing expression of a target polynucleotide by using a nucleic acid-targeting complex that binds to the DNA or RNA (e.g., mRNA or pre-mRNA). In some methods, a target RNA can be inactivated to effect the modification of the expression in a cell. For example, upon the binding of a RNA-targeting complex to a target sequence in a cell, the target RNA is inactivated such that the sequence is not translated, the coded protein is not produced, or the sequence does not function as the wild-type sequence does. For example, a protein or microRNA coding sequence may be inactivated such that the protein or microRNA or pre-microRNA transcript is not produced. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA). Examples of target RNA include a sequence associated with a signaling biochemical pathway, e.g., a signaling biochemical pathway-associated RNA. Examples of target RNA include a disease associated RNA. A "disease-associated" RNA refers to any RNA which is yielding translation products at an abnormal level or in an abnormal form in cells derived from a disease-affected tissues compared with tissues or cells of a non disease control. It may be a RNA transcribed from a gene that becomes expressed at an abnormally high level; it may be a RNA transcribed from a gene that becomes expressed at an abnormally low level, where the altered expression correlates with the occurrence and/or progression of the disease. A disease-associated RNA also refers to a RNA transcribed from a gene possessing mutation(s) or genetic variation that is directly responsible or is in linkage disequilibrium with a gene(s) that is responsible for the etiology of a disease. The translated products may be known or unknown, and may be at a normal or abnormal level. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, ncRNA, tRNA, or rRNA).

In some embodiments, the method may comprise allowing a nucleic acid-targeting complex to bind to the target DNA or RNA to effect cleavage of said target DNA or RNA thereby modifying the target DNA or RNA, wherein the nucleic acid-targeting complex comprises a nucleic acid-targeting effector protein complexed with a guide RNA hybridized to a target sequence within said target DNA or RNA. In one aspect, the invention provides a method of modifying expression of DNA or RNA in a eukaryotic cell. In some embodiments, the method comprises allowing a nucleic acid-targeting complex to bind to the DNA or RNA such that said binding results in increased or decreased expression of said DNA or RNA; wherein the nucleic acid-targeting complex comprises a nucleic acid-targeting effector protein complexed with a guide RNA. Similar considerations and conditions apply as above for methods of modifying a target DNA or RNA. In fact, these sampling, culturing and re-introduction options apply across the aspects of the present invention. In one aspect, the invention provides for methods of modifying a target DNA or RNA in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

Indeed, in any aspect of the invention, the nucleic acid-targeting complex may comprise a nucleic acid-targeting effector protein complexed with a guide RNA hybridized to a target sequence.

The invention relates to the engineering and optimization of systems, methods and compositions used for the control of gene expression involving DNA or RNA sequence targeting, that relate to the nucleic acid-targeting system and components thereof. In advantageous embodiments, the effector proteinenzyme is a Type VI protein such as C2c2.

An advantage of the present methods is that the CRISPR system minimizes or avoids off-target binding and its resulting side effects. This is achieved using systems arranged to have a high degree of sequence specificity for the target DNA or RNA.

In relation to a nucleic acid-targeting complex or system preferably, the tracr sequence has one or more hairpins and is 30 or more nucleotides in length, 40 or more nucleotides in length, or 50 or more nucleotides in length; the crRNA sequence is between 10 to 30 nucleotides in length, the nucleic acid-targeting effector protein is a Type VI effector protein.

In certain embodiments, the effector protein may be a *Listeria* sp. C2c2p, preferably *Listeria seeligeria* C2c2p, more preferably *Listeria seeligeria* serovar 1/2b str. SLCC3954 C2c2p and the crRNA sequence may be 44 to 47 nucleotides in length, with a 5' 29-nt direct repeat (DR) and a 15-nt to 18-nt spacer.

In certain embodiments, the effector protein may be a *Leptotrichia* sp. C2c2p, preferably *Leptotrichia shahii* C2c2p, more preferably *Leptotrichia shahii* DSM 19757 C2c2p and the crRNA sequence may be 42 to 58 nucleotides in length, with a 5' direct repeat of at least 24 nt, such as a 5' 24-28-nt direct repeat (DR) and a spacer of at least 14 nt, such as a 14-nt to 28-nt spacer, or a spacer of at least 18 nt, such as 19, 20, 21, 22, or more nt, such as 18-28, 19-28, 20-28, 21-28, or 22-28 nt.

In certain embodiments, the effector protein may be a Type VI loci effector protein, more particularly a C2c2p, and the crRNA sequence may be 36 to 63 nucleotides in length, preferably 37-nt to 62-nt in length, or 38-nt to 61-nt in length, or 39-nt to 60-nt in length, more preferably 40-nt to 59-nt in length, or 41-nt to 58-nt in length, most preferably 42-nt to 57-nt in length. For example, the crRNA may comprise, consist essentially of or consist of a direct repeat (DR), preferably a 5' DR, 26-nt to 31-nt in length, preferably 27-nt to 30-nt in length, even more preferably 28-nt or 29-nt in length or at least 28 or 29 nt in length, and a spacer 10-nt to 32-nt in length, preferably 11-nt to 31-nt in length, more preferably 12-nt to 30-nt in length, even more preferably 13-nt to 29-nt in length, and most preferably 14-nt to 28-nt in length, such as 18-28 nt, 19-28 nt, 20-28 nt, 21-28 nt, or 22-28 nt.

In certain embodiments, the effector protein may be a Type VI loci effector protein, more particularly a C2c2p, and the tracrRNA sequence may be at least 60-nt long, such as at least 65-nt in length, or at least 70-nt in length, such as from 60-nt to 70-nt in length, or from 60-nt to 70-nt in length, or from 70-nt to 80-nt in length, or from 80-nt to 90-nt in length, or from 90-nt to 100-nt in length, or from 100-nt to 110-nt in length, or from 110-nt to 120-nt in length, or from 120-nt to 130-nt in length, or from 130-nt to 140-nt in length, or from 140-nt to 150-nt in length, or more than 150-nt in length. See illustrative examples in FIG. 22-37.

In certain embodiments, the effector protein may be a Type VI loci effector protein, more particularly a C2c2p, and no tracrRNA may be required for cleavage.

The use of two different aptamers (each associated with a distinct nucleic acid-targeting guide RNAs) allows an activator-adaptor protein fusion and a repressor-adaptor protein fusion to be used, with different nucleic acid-targeting guide RNAs, to activate expression of one DNA or RNA, whilst repressing another. They, along with their different guide RNAs can be administered together, or substantially together, in a multiplexed approach. A large number of such modified nucleic acid-targeting guide RNAs can be used all at the same time, for example 10 or 20 or 30 and so forth, whilst only one (or at least a minimal number) of effector protein molecules need to be delivered, as a comparatively small number of effector protein molecules can be used with a large number modified guides. The adaptor protein may be associated (preferably linked or fused to) one or more activators or one or more repressors. For example, the adaptor protein may be associated with a first activator and a second activator. The first and second activators may be the same, but they are preferably different activators. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the nucleic acid-targeting effector protein-guide RNA complex as a whole may be associated with two or more functional domains. For example, there may be two or more functional domains associated with the nucleic acid-targeting effector protein, or there may be two or more functional domains associated with the guide RNA (via one or more adaptor proteins), or there may be one or more functional domains associated with the nucleic acid-targeting effector protein and one or more functional domains associated with the guide RNA (via one or more adaptor proteins).

The fusion between the adaptor protein and the activator or repressor may include a linker. For example, GlySer linkers GGGS can be used. They can be used in repeats of 3 ((GGGGS)$_3$) or 6, 9 or even 12 or more, to provide suitable lengths, as required. Linkers can be used between the guide RNAs and the functional domain (activator or repressor), or between the nucleic acid-targeting effector protein and the functional domain (activator or repressor). The linkers the user to engineer appropriate amounts of "mechanical flexibility".

The invention comprehends a nucleic acid-targeting complex comprising a nucleic acid-targeting effector protein and a guide RNA, wherein the nucleic acid-targeting effector protein comprises at least one mutation, such that the nucleic acid-targeting Cas protein has no more than 5% of the activity of the nucleic acid-targeting Cas protein not having the at least one mutation and, optionally, at least one or more nuclear localization sequences; the guide RNA comprises a guide sequence capable of hybridizing to a target sequence in a RNA of interest in a cell; and wherein: the nucleic acid-targeting effector protein is associated with two or more functional domains; or at least one loop of the guide RNA is modified by the insertion of distinct RNA sequence(s) that bind to one or more adaptor proteins, and wherein the adaptor protein is associated with two or more functional domains; or the nucleic acid-targeting effector protein is associated with one or more functional domains and at least one loop of the guide RNA is modified by the insertion of distinct RNA sequence(s) that bind to one or more adaptor proteins, and wherein the adaptor protein is associated with one or more functional domains.

Delivery Generally
C2c2 Effector Protein Complexes Can Deliver Functional Effectors Unlike CRISPR-Cas-mediated gene knockout, which permanently eliminates expression by mutating the gene at the DNA level, CRISPR-Cas knockdown allows for temporary reduction of gene expression through the use of artificial transcription or translation factors. Mutating key residues in both DNA or RNA cleavage domains of the C2c2 protein results in the generation of a catalytically inactive C2c2. A catalytically inactive C2c2 complexes with a guide RNA and localizes to the DNA or RNA sequence specified by that guide RNA's targeting domain, however, it does not cleave the target DNA or RNA. Fusion of the inactive C2c2 protein to an effector domain, e.g., a transcription or translation repression domain, enables recruitment of the effector to any DNA or RNA site specified by the guide RNA. In certain embodiments, C2c2 may be fused to a transcriptional repression domain and recruited to the promoter region of a gene. Especially for gene repression, it is contemplated herein that blocking the binding site of an endogenous transcription factor would aid in downregulating gene expression. In another embodiment, an inactive C2c2 can be fused to a chromatin modifying protein. Altering chromatin status can result in decreased expression of the target gene. In further embodiments, C2c2 may be fused to a translation repression domain.

In an embodiment, a guide RNA molecule can be targeted to a known transcription response elements (e.g., promoters, enhancers, etc.), a known upstream activating sequences, and/or sequences of unknown or known function that are suspected of being able to control expression of the target DNA.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced. In some methods, a target polynucleotide can be inactivated to effect the modification of the expression in a cell. For example, upon the binding of a CRISPR complex to an RNA target sequence in a cell, the target polynucleotide is inactivated such that the sequence is not translated, affecting the expression level of the protein in the cell.

In particular embodiments, the CRISPR enzyme comprises one or more mutations selected from the group consisting of R597A, H602A, R1278A and H1283A and/or the one or more mutations are in the HEPN domain of the CRISPR enzyme or is a mutation as otherwise discussed herein. In some embodiments, the CRISPR enzyme has one or more mutations in a catalytic domain, wherein when transcribed, the direct repeat sequence forms a single stem loop and the guide sequence directs sequence-specific binding of a CRISPR complex to the target sequence, and wherein the enzyme further comprises a functional domain. In some embodiments, the functional domain is a. In some embodiments, the functional domain is a transcription repression domain, preferably KRAB. In some embodiments, the transcription repression domain is SID, or concatemers of SID (eg SID4X). In some embodiments, the functional domain is an epigenetic modifying domain, such that an epigenetic modifying enzyme is provided. In some embodiments, the functional domain is an activation domain, which may be the P65 activation domain.

Delivery of the C2c2 Effector Protein Complex or Components Thereof

Through this disclosure and the knowledge in the art, TALEs, CRISPR-Cas systems, or components thereof or nucleic acid molecules thereof or nucleic acid molecules encoding or providing components thereof may be delivered by a delivery system herein described both generally and in detail.

Vector delivery, e.g., plasmid, viral delivery: The CRISPR enzyme, for instance a Type V protein such as C2c2, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Effector proteins and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1\times10^5$ particles (also referred to as particle units, pu) of adenoviral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^9$-$1\times10^{12}$ particles), and most preferably at least about $1\times10^0$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the adenoviral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ articles). Thus, the dose may contain a single dose of adenoviral vector with, for example, about $1\times10^6$ particle units (pu), about $2\times10^6$ pu, about $4\times10^6$ pu, about $1\times10^7$ pu, about $2\times10^7$ pu, about $4\times10^7$ pu, about $1\times10^8$ pu, about $2\times10$ pu, about $4\times10^8$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1\times10^{10}$ to about $1\times10^{10}$ functional AAV/ml solution. The dosage may be adjusted to balance the therapeutic benefit against any side effects. In an embodiment herein, the AAV dose is generally in the range of concentrations of from about $1\times10^5$ to $1\times10^{50}$ genomes AAV, from about $1\times10^8$ to $1\times10^{20}$ genomes AAV, from about $1\times10^{10}$ to about $1\times10^{16}$ genomes, or about $1\times10^{11}$ to about $1\times10^{16}$ genomes AAV. A human dosage may be about $1\times10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 µg to about 10 µg per 70 kg individual. Plasmids of the invention will generally comprise (i) a promoter; (ii) a sequence encoding an nucleic acid-targeting CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention.

siRNA has recently been successfully used for inhibition of gene expression in primates (see for example. Tolentino et al., Retina 24(4):660 which may also be applied to the present invention.

Indeed, RNA delivery is a useful method of in vivo delivery. It is possible to deliver nucleic acid-targeting Cas proteinCas9 and guide RNAgRNA (and, for instance, HR repair template) into cells using liposomes or particles. Thus delivery of the nucleic acid-targeting Cas protein/CRISPR enzyme, such as a CasCas9 and/or delivery of the guide RNAs of the invention may be in RNA form and via microvesicles, liposomes or particles. For example, Cas mRNA and guide RNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the RNA-targeting system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E ($\alpha$-tocopherol) may be conjugated with nucleic acid-targeting Cas protein and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, Calif.) filled with phosphate-buffered saline (PBS) or free TocsiBACE or TocsiBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of nucleic acid-targeting effector protein conjugated to a-tocopherol and co-administered with HDL targeted to the brain may be contemplated for humans in the present invention, for example, about 3 nmol to about 3 µmol of nucleic acid-targeting effector protein targeted to the brain may be contemplated. Zou et al. ((HUMAN GENE THERAPY 22:465-475 (April 2011)) describes a method of lentiviral-mediated delivery of short-hairpin RNAs targeting PKC7 for in vivo gene silencing in the spinal cord of rats. Zou et al. administered about 10 µl of a recombinant lentivirus having a titer of $1 \times 10^9$ transducing units (TU)/ml by an intrathecal catheter. A similar dosage of nucleic acid-targeting effector protein expressed in a lentiviral vector targeted to the brain may be contemplated for humans in the present invention, for example, about 10-50 ml of nucleic acid-targeting effector protein targeted to the brain in a lentivirus having a titer of $1 \times 10^9$ transducing units (TU)/ml may be contemplated.

In terms of local delivery to the brain, this can be achieved in various ways. For instance, material can be delivered intrastriatally e.g., by injection. Injection can be performed stereotactically via a craniotomy.

Enhancing NHEJ or HR efficiency is also helpful for delivery. It is preferred that NHEJ efficiency is enhanced by co-expressing end-processing enzymes such as Trex2 (Dumitrache et al. Genetics. 2011 August; 188(4): 787-797). It is preferred that HR efficiency is increased by transiently inhibiting NHEJ machineries such as Ku70 and Ku86. HR efficiency can also be increased by co-expressing prokaryotic or eukaryotic homologous recombination enzymes such as RecBCD, RecA.

Packaging and Promoters Generally

Ways to package nucleic acid-targeting effector protein (such as a Type V protein such as C2c2) coding nucleic acid molecules, e.g., DNA, into vectors, e.g., viral vectors, to mediate genome modification in vivo include:

To achieve NHEJ-mediated gene knockout:
  Single virus vector:
    Vector containing two or more expression cassettes:
    Promoter-nucleic acid-targeting effector protein coding nucleic acid molecule-terminator
    Promoter—guide RNA1-terminator
    Promoter—guide RNA (N)-terminator (up to size limit of vector)
  Double virus vector:
    Vector 1 containing one expression cassette for driving the expression of nucleic acid-targeting effector protein (such as a Type V protein such as C2c2)
    Promoter-nucleic acid-targeting effector protein coding nucleic acid molecule-terminator
    Vector 2 containing one more expression cassettes for driving the expression of one or more guideRNAs
    Promoter—guide RNA1-terminator
    Promoter—guide RNA1 (N)-terminator (up to size limit of vector)

To mediate homology-directed repair.

In addition to the single and double virus vector approaches described above, an additional vector is used to deliver a homology-direct repair template.

The promoter used to drive nucleic acid-targeting effector protein (such as a Type V protein such as C2c2) coding nucleic acid molecule expression can include:

AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of nucleic acid-targeting effector protein (such as a Type V protein such as C2c2).

For ubiquitous expression, can use promoters: CMV, CAG, CBh, PGK, SV40, Ferritin heavy or light chains, etc.

For brain or other CNS expression, can use promoters: SynapsinI for all neurons, CaMKIIalpha for excitatory neurons, GAD67 or GAD65 or VGAT for GABAergic neurons, etc.

For liver expression, can use Albumin promoter.
For lung expression, can use SP-B.
For endothelial cells, can use ICAM.
For hematopoietic cells can use IFNbeta or CD45.
For Osteoblasts can use OG-2.
The promoter used to drive guide RNA can include:
Pol III promoters such as U6 or H1
Use of Pol II promoter and intronic cassettes to express guide RNA
Adeno Associated Virus (AAV)

nucleic acid-targeting effector protein (such as a Type V protein such as C2c2) and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g., a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome/transcriptome modification, the expression of nucleic acid-targeting effector protein (such as a Type V protein such as C2c2) can be driven by a cell-type specific promoter. For example, liver-specific expression might use the Albumin promoter and neuron-specific expression (e.g., for targeting CNS disorders) might use the Synapsin I promoter.

In terms of in vivo delivery, AAV is advantageous over other viral vectors for a couple of reasons:

Low toxicity (this may be due to the purification method not requiring ultra centrifugation of cell particles that can activate the immune response) and Low probability of causing insertional mutagenesis because it doesn't integrate into the host genome.

AAV has a packaging limit of 4.5 or 4.75 Kb. This means that nucleic acid-targeting effector protein (such as a Type V protein such as C2c2) as well as a promoter and transcription terminator have to be all fit into the same viral vector. Therefore embodiments of the invention include utilizing homologs of nucleic acid-targeting effector protein (such as a Type V protein such as C2c2) that are shorter.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

TABLE 1

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 μg of lentiviral transfer plasmid (pCasES10) and the following packaging plasmids: 5 μg of pMD2.G (VSV-g pseudotype), and 7.5 ug of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4 C. They were then aliquotted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine inffctious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the nucleic acid-targeting system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the nucleic acid-targeting system of the present invention. A minimum of $2.5 \times 10^6$ CD34+ cells per kilogram patient weight may be collected and prestimulated for 16 to 20 hours in X-VIVO 15 medium (Lonza) containing 2 pmol/L-glutamine, stem cell factor (100 ng/ml), Flt-3 ligand (Flt-3L) (100 ng/ml), and thrombopoietin (10 ng/ml) (CellGenix) at a density of $2 \times 10^6$ cells/ml. Prestimulated cells may be transduced with lentiviral at a multiplicity of infection of 5 for 16 to 24 hours in 75-cm$^2$ tissue culture flasks coated with fibronectin (25 mg/cm$^2$) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259,015.

RNA Delivery

RNA delivery: The nucleic acid-targeting Cas protein, for instance a Type V protein such as C2c2, and/or guide RNA, can also be delivered in the form of RNA. nucleic acid-targeting Cas protein (such as a Type VI protein such as C2c2) mRNA can be generated using in vitro transcription. For example, nucleic acid-targeting effector protein (such as a Type V protein such as C2c2) mRNA can be synthesized using a PCR cassette containing the following elements: T7_promoter-kozak sequence (GCCACC)-effector protein-3' UTR from beta globin-polyA tail (a string of 120 or more adenines). The cassette can be used for transcription by T7 polymerase. Guide RNAs can also be transcribed using in vitro transcription from a cassette containing T7_promoter-GG-guide RNA sequence.

To enhance expression and reduce possible toxicity, the nucleic acid-targeting effector protein-coding sequence and/or the guide RNA can be modified to include one or more modified nucleoside e.g., using pseudo-U or 5-Methyl-C.

mRNA delivery methods are especially promising for liver delivery currently.

Much clinical work on RNA delivery has focused on RNAi or antisense, but these systems can be adapted for delivery of RNA for implementing the present invention. References below to RNAi etc. should be read accordingly.

Particle Delivery Systems and/or Formulations:

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/onization time-of-flight mass spectrometry (MALDI-TOF), ultraviolet-visible spectroscopy, dual polarisation interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof.

Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

Particles

CRISPR enzyme mRNA and guide RNA may be delivered simultaneously using particles or lipid envelopes; for instance, CRISPR enzyme and RNA of the invention, e.g., as a complex, can be delivered via a particle as in Dahlman et al., W2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1×PBS; and separately, DOTAP, DMPC, PEG, and cholesterol as applicable for the formulation are dissolved in alcohol, e.g., 100% ethanol; and, the two solutions are mixed together to form particles containing the complexes).

Nucleic acid-targeting effector proteins (such as a Type VI protein such as C2c2) mRNA and guide RNA may be delivered simultaneously using particles or lipid envelopes.

For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured particles with a poly(β-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles based on self-assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X., et al. Biomacromolecules, 2006. 7(12):3452-9 and Uchegbu, I. F., et al. Int J Pharm, 2001. 224:185-199). Doses of about 5 mg/kg are contemplated, with single or multiple doses, depending on the target tissue.

In one embodiment, particles that can deliver RNA to a cancer cell to stop tumor growth developed by Dan Anderson's lab at MIT may be used/and or adapted to the nucleic acid-targeting system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

US patent application 20110293703 relates to lipidoid compounds are also particularly useful in the administration of polynucleotides, which may be applied to deliver the nucleic acid-targeting system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The minoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30–100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell.

US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the nucleic acid-targeting system of the present invention.

In another embodiment, lipid nanoparticles (LNPs) are contemplated. An antitransthyretin small interfering RNA has been encapsulated in lipid nanoparticles and delivered to humans (see, e.g., Coelho et al., N Engl J Med 2013; 369:819-29), and such a system may be adapted and applied to the nucleic acid-targeting system of the present invention. Doses of about 0.01 to about 1 mg per kg of body weight administered intravenously are contemplated. Medications to reduce the risk of infusion-related reactions are contemplated, such as dexamethasone, acetampinophen, diphenhydramine or cetirizine, and ranitidine are contemplated. Multiple doses of about 0.3 mg per kilogram every 4 weeks for five doses are also contemplated.

LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding nucleic acid-targeting effector protein to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethyl-ammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, December 2011). A dosage of 1 µg/ml of LNP or CRISPR-Cas RNA in or associated with the LNP may be contemplated, especially for a formulation containing DLinKC2-DMA.

Preparation of LNPs and CRISPR-Cas encapsulation may be used/and or adapted from Rosin et al, Molecular Therapy, vol. 19, no. 12, pages 1286-2200, December 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(o-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, Mo.). The specific nucleic acid-targeting complex (CRISPR-Cas) RNA may be encapsulated in LNPs containing DLinDAP, DLinDMA, DLinK-DMA, and DLinKC2-DMA (cationic lipid:DSPC:CHOL:PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/I citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Particle size distribution may be determined by dynamic light scattering using a NICOMP 370 particle sizer, the vesicle/intensity modes, and Gaussian fitting (Nicomp Particle Sizing, Santa Barbara, Calif.). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted particles and quantified at 260 nm. RNA to lipid ratio was determined by measurement of cholesterol content in vesicles using the Cholesterol E enzymatic assay from Wako Chemicals USA (Richmond, Va.). In conjunction with the herein discussion of LNPs and PEG lipids, PEGylated liposomes or LNPs are likewise suitable for delivery of a nucleic acid-targeting system or components thereof.

Preparation of large LNPs may be used/and or adapted from Rosin et al, Molecular Therapy, vol. 19, no. 12, pages 1286-2200, December 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate: DLinKC2-DMA). The lipids may be subsequently hydrated by combining the mixture with 1.85 volumes of citrate buffer (10 mmol/l, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at a RNA to total lipid ratio of approximately 1:10 (wt:wt), followed by incubation for 30 minutes at 37° C. to form loaded LNPs. The mixture may be subsequently dialyzed overnight in PBS and filtered with a 0.45-µm syringe filter.

Spherical Nucleic Acid (SNA™) constructs and other particles (particularly gold particles) are also contemplated as a means to delivery nucleic acid-targeting system to intended targets. Significant data show that AuraSense Therapeutics' Spherical Nucleic Acid (SNA™) constructs, based upon nucleic acid-functionalized gold particles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S4-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling particles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of nucleic acid-targeting complex RNA is envisioned for delivery in the self-assembling particles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclododecane-1,4,7,10-tetraacetic acid mono(N-hydroxysuccinimide ester) (DOTA-NHSester) was ordered from Macrocyclics (Dallas, Tex.). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, Calif.) to remove trace metal contaminants. Tf-targeted and nontargeted siRNA particles may be formed by using cyclodextrin-containing polycations. Typically, particles were formed in water at a charge ratio of 3 (+/−) and an siRNA concentration of 0.5 g/liter. One percent of the adamantane-PEG molecules on the surface of the targeted particles were modified with Tf (adamantane-PEG-Tf). The particles were suspended in a 5% (wt/vol) glucose carrier solution for injection.

Davis et al. (Nature, Vol 464, 15 Apr. 2010) conducts a RNA clinical trial that uses a targeted particle-delivery system (clinical trial registration number NCT00689065). Patients with solid cancers refractory to standard-of-care therapies are administered doses of targeted particles on days 1, 3, 8 and 10 of a 21-day cycle by a 30-min intravenous infusion. The particles comprise, consist essentially of, or consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These particles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumours, Davis et al. investigated biopsies from three patients from three different dosing cohorts; patients A, B and C, all of whom had metastatic melanoma and received CALAA-01 doses of 18, 24 and 30 mg m siRNA, respectively. Similar doses may also be contemplated for the nucleic acid-targeting system of the present invention. The delivery of the invention may be achieved with particles containing a linear, cyclodextrin-based polymer (CDP), a human transferrin protein (TF) targeting ligand displayed on the exterior of the particle to engage TF receptors (TFR) on the surface of the cancer cells and/or a hydrophilic polymer (for example, polyethylene glycol (PEG) used to promote particle stability in biological fluids).

In terms of this invention, it is preferred to have one or more components of nucleic acid-targeting complex, e.g., nucleic acid-targeting effector protein or mRNA, or guide RNA delivered using particles or lipid envelopes. Other delivery systems or vectors are may be used in conjunction with the particle aspects of the invention.

In general, a "nanoparticle" refers to any particle having a diameter of less than 1000 nm. In certain preferred embodiments, nanoparticles of the invention have a greatest dimension (e.g., diameter) of 500 nm or less. In other preferred embodiments, nanoparticles of the invention have a greatest dimension ranging between 25 nm and 200 nm. In other preferred embodiments, particles of the invention have a greatest dimension of 100 nm or less. In other preferred embodiments, nanoparticles of the invention have a greatest dimension ranging between 35 nm and 60 nm.

Particles encompassed in the present invention may be provided in different forms, e.g., as solid particles (e.g., metal such as silver, gold, iron, titanium), non-metal, lipid-based solids, polymers), suspensions of particles, or combinations thereof. Metal, dielectric, and semiconductor particles may be prepared, as well as hybrid structures (e.g., core-shell particles). Particles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft particles have been manufactured, and are within the scope of the present invention. A prototype particle of semi-solid nature is the liposome. Various types of liposome particles are currently used clinically as delivery systems for anticancer drugs and vaccines. Particles with one half hydrophilic and the other half hydrophobic are termed Janus particles and are particularly effective for stabilizing emulsions. They can self-assemble at water/oil interfaces and act as solid surfactants.

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid.

U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material.

U.S. Pat. No. 5,855,913, incorporated herein by reference, provides a particulate composition having aerodynamically light particles having a tap density of less than 0.4 g/cm3 with a mean diameter of between 5 µm and 30 µm, incorporating a surfactant on the surface thereof for drug delivery to the pulmonary system.

U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system.

U.S. Pat. No. 5,543,158, incorporated herein by reference, provides biodegradable injectable particles having a biodegradable solid core containing a biologically active material and poly(alkylene glycol) moieties on the surface.

WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can be envisioned that such methods and materials of herein-cited documents, e.g., conjugated lipomers can be used in the context of the nucleic acid-targeting system to achieve in vitro, ex vivo and in vivo genomic perturbations to modify gene expression, including modulation of protein expression.

In one embodiment, the particle may be epoxide-modified lipid-polymer, advantageously 7C1 (see, e.g., James E. Dahlman and Carmen Barnes et al. Nature Nanotechnology (2014) published online 11 May 2014, doi:10.1038/nnano.2014.84). C71 was synthesized by reacting C15 epoxide-terminated lipids with PEI600 at a 14:1 molar ratio, and was formulated with C14PEG2000 to produce particles (diameter between 35 and 60 nm) that were stable in PBS solution for at least 40 days.

An epoxide-modified lipid-polymer may be utilized to deliver the nucleic acid-targeting system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg.

Exosomes

Exosomes are endogenous nano-vesicles that transport RNAs and proteins, and which can deliver RNA to the brain and other target organs. To reduce immunogenicity, Alvarez-Erviti et al. (2011, Nat Biotechnol 29: 341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by particle tracking analysis (NTA) and electron microscopy. Alvarez-Erviti et al. obtained 6-12 µg of exosomes (measured based on protein concentration) per $10^6$ cells.

Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 pF resulted in the greatest retention of RNA and was used for all subsequent experiments.

Alvarez-Erviti et al. administered 150 µg of each BACE1 siRNA encapsulated in 150 µg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, P<0.05, versus 62%, P<0.01) in both siRNA-RVG-9R-treated and siRNARVG exosome-treated mice was observed, resulting from a significant decrease in BACE1 mRNA levels (66% [+ or −] 15%, P<0.001 and 61% [+ or −] 13% respectively, P<0.01). Moreover, Applicants demonstrated a significant decrease (55%, P<0.05) in the total [beta]-amyloid 1-42 levels, a main component of the amyloid plaques in Alzheimer's pathology, in the RVG-exosome-treated animals. The decrease observed was greater than the p-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA.

Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the nucleic acid-targeting system of the present invention to therapeutic targets, especially neurodegenerative diseases. A dosage of about 100 to 1000 mg of nucleic acid-targeting system encapsulated in about 100 to 1000 mg of RVG exosomes may be contemplated for the present invention.

El-Andaloussi et al. (Nature Protocols 7,2112-2126 (2012)) discloses how exosomes derived from cultured cells can be harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention.

Exosomes from plasma can be prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of nucleic acid-targeting system into exosomes may be conducted similarly to siRNA. The exosomes may be co-cultured with monocytes and lymphocytes isolated from the peripheral blood of healthy donors. Therefore, it may be contemplated that exosomes containing nucleic acid-targeting system may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review).

A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review).

In a particularly advantageous embodiment, Trojan Horse liposomes (also known as Molecular Trojan Horses) are desirable and protocols may be found at cshlp.org/content/2010/4/pdb. These particles allow delivery of a transgene to the entire brain after an intravascular injection. Without being bound by limitation, it is believed that neutral lipid particles with specific antibodies conjugated to surface allow crossing of the blood brain barrier via endocytosis. Applicant postulates utilizing Trojan Horse Liposomes to deliver the CRISPR family of nucleases to the brain via an intravascular injection, which would allow whole brain transgenic animals without the need for embryonic manipulation. About 1-5 g of DNA or RNA may be contemplated for in vivo administration in liposomes.

In another embodiment, the nucleic acid-targeting system or conmponents thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific nucleic acid-targeting system targeted in a SNALP are contemplated. The daily treatment may be over about three days and then weekly for about five weeks. In another embodiment, a specific nucleic acid-targeting system encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(wmethoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, Mo., USA), dipalmitoylphosphatidylcholine (Avanti Polar Lipids, Alabaster, Ala., USA), 3-N-[(w-methoxy poly(ethylene glycol) 2000)carbamoyl]-1,2-dimyrestyloxypropylamine, and cationic 1,2-dilinoleyloxy-3-N,Ndimethylaminopropane (see, e.g., Geisbert et al., Lancet 2010; 375: 1896-905). A dosage of about 2 mg/kg total nucleic acid-targeting systemper dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N;N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids—an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial.

Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC)—both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at ≥0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Niotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM Na$_2$HPO4, 1 mM KH$_2$PO$_4$, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 µm filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the nucleic acid-targeting system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate nucleic acid-targeting system or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.110.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume:29, Pages: 154-157 (2011)) describes the use of lipid envelopes to deliver RNA. Use of lipid envelopes is also preferred in the present invention.

In another embodiment, lipids may be formulated with the nucleic acid-targeting system of the present invention or component(s) thereof or nucleic acid molecule(s) coding therefor to form lipid nanoparticles (LNPs). Lipids include, but are not limited to, DLin-KC2-DMA4, C12-200 and colipids disteroylphosphatidyl choline, cholesterol, and PEG-DMG may be formulated with RNA-targeting system instead of siRNA (see, e.g., Novobrantseva, Molecular Therapy—Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid:siRNA weight ratio may be ~12:1 and 9:1 in the case of DLin-KC2-DMA and C12-200 lipid particles (LNPs), respectively. The formulations may have mean particle diameters of ~80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The nucleic acid-targetingsystem or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid:fusogenic lipid:cholesterol:PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesized from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N—P($O_2$)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied.

US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of nucleic acid-targeting system(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of nucleic acid-targetingsystem(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified+36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116). However, pilot experiments varying the dose of protein and RNA should be performed to optimize the procedure for specific cell lines.

(1) One day before treatment, plate $1\times10^5$ cells per well in a 48-well plate.

(2) On the day of treatment, dilute purified+36 GFP protein in serumfree media to a final concentration 200 nM. Add RNA to a final concentration of 50 nM. Vortex to mix and incubate at room temperature for 10 min.

(3) During incubation, aspirate media from cells and wash once with PBS.

(4) Following incubation of +36 GFP and RNA, add the protein-RNA complexes to cells.

(5) Incubate cells with complexes at 37° C. for 4h.

(6) Following incubation, aspirate the media and wash three times with 20 U/mL heparin PBS. Incubate cells with serum-containing media for a further 48h or longer depending upon the assay for activity.

(7) Analyze cells by immunoblot, qPCR, phenotypic assay, or other appropriate method.

David Liu's lab has further found +36 GFP to be an effective plasmid delivery reagent in a range of cells. As plasmid DNA is a larger cargo than siRNA, proportionately more +36 GFP protein is required to effectively complex plasmids. For effective plasmid delivery Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications.

(1) One day before treatment, plate $1\times10^5$ per well in a 48-well plate.

(2) On the day of treatment, dilute purified 36 GFP protein in serumfree media to a final concentration 2 mM. Add 1 mg of plasmid DNA. Vortex to mix and incubate at room temperature for 10 min.

(3) During incubation, aspirate media from cells and wash once with PBS.

(4) Following incubation of 36 GFP and plasmid DNA, gently add the protein-DNA complexes to cells.

(5) Incubate cells with complexes at 37 C for 4h.

(6) Following incubation, aspirate the media and wash with PBS. Incubate cells in serum-containing media and incubate for a further 24-48h.

(7) Analyze plasmid delivery (e.g., by plasmid-driven gene expression) as appropriate.

See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the nucleic acid-targeting system of the present invention. These systems of Dr. Lui and documents herein in conjunction with herein teachings can be employed in the delivery of nucleic acid-targeting system(s) or component(s) thereof or nucleic acid molecule(s) coding therefor.

Cell Penetrating Peptides (CPPs)

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, particles including nanoparticles, liposomes, chromophores, small molecules and radioactive materials. In aspects of the invention, the cargo may also comprise any component of the CRISPR Cas system or the entire functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intrarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions.

The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R4) (Ahx=aminohexanoyl).

U.S. Pat. No. 8,372,951, provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019. CPPs can be used to deliver the CRISPR-Cas system or components thereof. That CPPs can be employed to deliver the CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Implantable Devices

In another embodiment, implantable devices are also contemplated for delivery of the nucleic acid-targeting system or component(s) thereof or nucleic acid molecule(s) coding therefor. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. An implantable delivery device can be advantageous in providing release locally and over a prolonged period, where drug is released directly to the extracellular matrix (ECM) of the diseased area such as tumor, inflammation, degeneration or for symptomatic objectives, or to injured smooth muscle cells, or for prevention. One kind of drug is RNA, as disclosed above, and this system may be used/and or adapted to the nucleic acid-targeting system of the present invention. The modes of implantation in some embodiments are existing implantation procedures that are developed and used today for other treatments, including brachytherapy and needle biopsy. In such cases the dimensions of the new implant described in this invention are similar to the original implant. Typically a few devices are implanted during the same treatment procedure.

US Patent Publication 20110195123, provides a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123.

The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 m$^3$ to 1000 mm$^3$, as required by the volume for the agent load. The Loder may optionally be larger, for example when incorporated with a device whose size is determined by functionality, for example and without limitation, a knee joint, an intra-uterine or cervical ring and the like.

The drug delivery system (for delivering the composition) is designed in some embodiments to preferably employ degradable polymers, wherein the main release mechanism is bulk erosion; or in some embodiments, non degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or may fluctuate, for example increasing and decreasing to a certain degree. The diffusion rate is preferably so maintained for a prolonged period, and it can be considered constant to a certain level to optimize the therapeutically effective period, for example the effective silencing period.

The drug delivery system optionally and preferably is designed to shield the nucleotide based therapeutic agent from degradation, whether chemical in nature or due to attack from enzymes and other factors in the body of the subject.

The drug delivery system of US Patent Publication 20110195123 is optionally associated with sensing and/or activation appliances that are operated at and/or after implantation of the device, by non and/or minimally invasive methods of activation and/or acceleration/deceleration, for example optionally including but not limited to thermal heating and cooling, laser beams, and ultrasonic, including focused ultrasound and/or RF (radiofrequency) methods or devices.

According to some embodiments of US Patent Publication 20110195123, the site for local delivery may optionally include target sites characterized by high abnormal proliferation of cells, and suppressed apoptosis, including tumors, active and or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle.

The site for implantation of the composition, or target site, preferably features a radius, area and/or volume that is sufficiently small for targeted local delivery. For example, the target site optionally has a diameter in a range of from about 0.1 mm to about 5 cm.

The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof.

For example the composition (optionally with the device) is optionally implanted within or in the proximity to pancreas, prostate, breast, liver, via the nipple, within the vascular system and so forth.

The target location is optionally selected from the group comprising, consisting essentially of, or consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear-auditory system, labyrinth of the inner ear, vestibular system; 11. Intra tracheal; 12. Intra-cardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example but without limitation, for ovary cancer); 24. Intra esophageal and 25. Intra rectal.

Optionally insertion of the system (for example a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site.

Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating and cooling, and ultrasonic, including focused ultrasound and/or RF (radiofrequency) methods or devices, and chemical activators.

According to other embodiments of U.S. Patent Publication 20110195123, the drug preferably comprises a RNA, for example for localized cancer cases in breast, pancreas, brain, kidney, bladder, lung, and prostate as described below. Although exemplified with RNAi, many drugs are applicable to be encapsulated in Loder, and can be used in association with this invention, as long as such drugs can be encapsulated with the Loder substrate, such as a matrix for example, and this system may be used and/or adapted to deliver the nucleic acid-targeting system of the present invention.

As another example of a specific application, neuro and muscular degenerative diseases develop due to abnormal gene expression. Local delivery of RNAs may have therapeutic properties for interfering with such abnormal gene expression. Local delivery of anti apoptotic, anti inflammatory and anti degenerative drugs including small drugs and macromolecules may also optionally be therapeutic. In such cases the Loder is applied for prolonged release at constant rate and/or through a dedicated device that is implanted separately. All of this may be used and/or adapted to the nucleic acid-targeting system of the present invention.

As yet another example of a specific application, psychiatric and cognitive disorders are treated with gene modifiers. Gene knockdown is a treatment option. Loders locally delivering agents to central nervous system sites are therapeutic options for psychiatric and cognitive disorders including but not limited to psychosis, bi-polar diseases, neurotic disorders and behavioral maladies. The Loders could also deliver locally drugs including small drugs and macromolecules upon implantation at specific brain sites. All of this may be used and/or adapted to the nucleic acid-targeting system of the present invention.

As another example of a specific application, silencing of innate and/or adaptive immune mediators at local sites enables the prevention of organ transplant rejection. Local delivery of RNAs and immunomodulating reagents with the Loder implanted into the transplanted organ and/or the implanted site renders local immune suppression by repelling immune cells such as CD8 activated against the transplanted organ. All of this may be used/and or adapted to the nucleic acid-targeting system of the present invention.

As another example of a specific application, vascular growth factors including VEGFs and angiogenin and others are essential for neovascularization. Local delivery of the factors, peptides, peptidomimetics, or suppressing their repressors is an important therapeutic modality; silencing the repressors and local delivery of the factors, peptides, macromolecules and small drugs stimulating angiogenesis with the Loder is therapeutic for peripheral, systemic and cardiac vascular disease.

The method of insertion, such as implantation, may optionally already be used for other types of tissue implantation and/or for insertions and/or for sampling tissues, optionally without modifications, or alternatively optionally only with non-major modifications in such methods. Such methods optionally include but are not limited to brachytherapy methods, biopsy, endoscopy with and/or without ultrasound, such as ERCP, stereotactic methods into the brain tissue, Laparoscopy, including implantation with a laparoscope into joints, abdominal organs, the bladder wall and body cavities.

Implantable device technology herein discussed can be employed with herein teachings and hence by this disclosure and the knowledge in the art, CRISPR-Cas system or components thereof or nucleic acid molecules thereof or encoding or providing components may be delivered via an implantable device.

Patient-Specific Screening Methods

A nucleic acid-targeting system that targets RNA, e.g., trinucleotide repeats can be used to screen patients or patent samples for the presence of such repeats. The repeats can be the target of the RNA of the nucleic acid-targeting system, and if there is binding thereto by the nucleic acid-targeting system, that binding can be detected, to thereby indicate that such a repeat is present. Thus, a nucleic acid-targeting system can be used to screen patients or patient samples for the presence of the repeat. The patient can then be administered suitable compound(s) to address the condition; or, can be administered a nucleic acid-targeting system to bind to and cause insertion, deletion or mutation and alleviate the condition.

The invention uses nucleic acids to bind target RNA sequences.

CRISPR Effector Protein mRNA and Guide RNA

CRISPR effector protein mRNA and guide RNA might also be delivered separately. CRISPR effector protein mRNA can be delivered prior to the guide RNA to give time for CRISPR effector protein to be expressed. CRISPR effector protein mRNA might be administered 1-12 hours (preferably around 2-6 hours) prior to the administration of guide RNA.

Alternatively, CRISPR effector protein mRNA and guide RNA can be administered together. Advantageously, a second booster dose of guide RNA can be administered 1-12 hours (preferably around 2-6 hours) after the initial administration of CRISPR effector protein mRNA+guide RNA.

The CRISPR effector protein of the present invention, i.e. a C2c2 effector protein is sometimes referred to herein as a CRISPR Enzyme. It will be appreciated that the effector protein is based on or derived from an enzyme, so the term 'effector protein' certainly includes 'enzyme' in some embodiments. However, it will also be appreciated that the effector protein may, as required in some embodiments, have DNA or RNA binding, but not necessarily cutting or nicking, activity, including a dead-Cas effector protein function.

Additional administrations of CRISPR effector protein mRNA and/or guide RNA might be useful to achieve the most efficient levels of genome modification. In some embodiments, phenotypic alteration is preferably the result of genome modification when a genetic disease is targeted, especially in methods of therapy and preferably where a repair template is provided to correct or alter the phenotype.

In some embodiments diseases that may be targeted include those concerned with disease-causing splice defects.

In some embodiments, cellular targets include Hemopoietic Stem/Progenitor Cells (CD34+); Human T cells; and Eye (retinal cells)—for example photoreceptor precursor cells.

In some embodiments Gene targets include: Human Beta Globin—HBB (for treating Sickle Cell Anemia, including by stimulating gene-conversion (using closely related HBD gene as an endogenous template)); CD3 (T-Cells); and CEP920—retina (eye).

In some embodiments disease targets also include: cancer; Sickle Cell Anemia (based on a point mutation); HIV; Beta-Thalassemia; and ophthalmic or ocular disease—for example Leber Congenital Amaurosis (LCA)-causing Splice Defect.

In some embodiments delivery methods include: Cationic Lipid Mediated "direct" delivery of Enzyme-Guide complex (RiboNucleoProtein) and electroporation of plasmid DNA.

Inventive methods can further comprise delivery of templates, such as repair templates, which may be dsODN or ssODN, see below. Delivery of templates may be via the cotemporaneous or separate from delivery of any or all the CRISPR effector protein or guide and via the same delivery mechanism or different. In some embodiments, it is preferred that the template is delivered together with the guide, and, preferably, also the CRISPR effector protein. An example may be an AAV vector.

Inventive methods can further comprise: (a) delivering to the cell a double-stranded oligodeoxynucleotide (dsODN) comprising overhangs complimentary to the overhangs created by said double strand break, wherein said dsODN is integrated into the locus of interest; or (b) delivering to the cell a single-stranded oligodeoxynucleotide (ssODN), wherein said ssODN acts as a template for homology directed repair of said double strand break. Inventive methods can be for the prevention or treatment of disease in an individual, optionally wherein said disease is caused by a defect in said locus of interest. Inventive methods can be conducted in vivo in the individual or ex vivo on a cell taken from the individual, optionally wherein said cell is returned to the individual.

For minimization of toxicity and off-target effect, it will be important to control the concentration of CRISPR effector protein mRNA and guide RNA delivered. Optimal concentrations of CRISPR effector protein mRNA and guide RNA can be determined by testing different concentrations in a cellular or animal model and using deep sequencing the analyze the extent of modification at potential off-target genomic loci. For example, for the guide sequence targeting 5'-GAGTCCGAGCAGAAGAAGAA-3' in the EMX1 gene of the human genome, deep sequencing can be used to assess the level of modification at the following two off-target loci, 1: 5'-GAGTCCTAGCAGGAGAAGAA-3' and 2: 5'-GAGTCTAAGCAGAAGAAGAA-3'. The concentration that gives the highest level of on-target modification while minimizing the level of off-target modification should be chosen for in vivo delivery.

Inducible Systems

In some embodiments, a CRISPR effector protein may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR effector protein may be a part of a Light Inducible Transcriptional Effector (LITE) to direct changes in transcriptional activity in a sequence-specific manner. The components of a light may include a CRISPR effector protein, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, and WO 2014018423 A2 which is hereby incorporated by reference in its entirety.

Exemplary Methods of Using of CRISPR Cas System

The invention provides a non-naturally occurring or engineered composition, or one or more polynucleotides encoding components of said composition, or vector or delivery systems comprising one or more polynucleotides encoding components of said composition for use in a modifying a target cell in vivo, ex vivo or in vitro and, may be conducted in a manner alters the cell such that once modified the progeny or cell line of the CRISPR modified cell retains the altered phenotype. The modified cells and progeny may be part of a multi-cellular organism such as a plant or animal with ex vivo or in vivo application of CRISPR system to desired cell types. The CRISPR invention may be a therapeutic method of treatment. The therapeutic method of treatment may comprise gene or genome editing, or gene therapy.

Modifying a Target with CRISPR Cas System or Complex (e.g., C2c2-RNA Complex)

In one aspect, the invention provides for methods of modifying a target polynucleotide in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

In some embodiments, the method comprises allowing a CRISPR complex to bind to the target polynucleotide to effect cleavage of said target polynucleotide thereby modifying the target polynucleotide, wherein the CRISPR complex comprises a CRISPR effector protein complexed with a guide sequence hybridized or hybridizable to a target sequence within said target polynucleotide.

In one aspect, the invention provides a method of modifying expression of a polynucleotide in a eukaryotic cell. In some embodiments, the method comprises allowing a CRISPR complex to bind to the polynucleotide such that said binding results in increased or decreased expression of said polynucleotide; wherein the CRISPR complex comprises a CRISPR effector protein complexed with a guide sequence hybridized or hybridizable to a target sequence within said polynucleotide. Similar considerations and conditions apply as above for methods of modifying a target polynucleotide. In fact, these sampling, culturing and re-introduction options apply across the aspects of the present invention.

Indeed, in any aspect of the invention, the CRISPR complex may comprise a CRISPR effector protein complexed with a guide sequence hybridized or hybridizable to a target sequence. Similar considerations and conditions apply as above for methods of modifying a target polynucleotide.

Thus in any of the non-naturally-occurring CRISPR effector proteins described herein comprise at least one modification and whereby the effector protein has certain improved capabilities. In particular, any of the effector proteins are capable of forming a CRISPR complex with a guide RNA. When such a complex forms, the guide RNA is capable of binding to a target polynucleotide sequence and the effector protein is capable of modifying a target locus. In addition, the effector protein in the CRISPR complex has reduced capability of modifying one or more off-target loci as compared to an unmodified enzyme/effector protein.

In addition, the modified CRISPR enzymes described herein encompass enzymes whereby in the CRISPR complex the effector protein has increased capability of modifying the one or more target loci as compared to an unmodified enzyme/effector protein. Such function may be provided separate to or provided in combination with the above-described function of reduced capability of modifying one or more off-target loci. Any such effector proteins may be provided with any of the further modifications to the CRISPR effector protein as described herein, such as in combination with any activity provided by one or more associated heterologous functional domains, any further mutations to reduce nuclease activity and the like.

In advantageous embodiments of the invention, the modified CRISPR effector protein is provided with reduced capability of modifying one or more off-target loci as compared to an unmodified enzyme/effector protein and increased capability of modifying the one or more target loci as compared to an unmodified enzyme/effector protein. In combination with further modifications to the effector protein, significantly enhanced specificity may be achieved. For example, combination of such advantageous embodiments with one or more additional mutations is provided wherein the one or more additional mutations are in one or more catalytically active domains. In such effector proteins, enhanced specificity may be achieved due to an improved specificity in terms of effector protein activity.

Modifications to reduce off-target effects and/or enhance on-target effects as described above may be made to amino acid residues located in a positively-charged region/groove situated between the RuvC-III and HNH domains. It will be appreciated that any of the functional effects described above may be achieved by modification of amino acids within the aforementioned groove but also by modification of amino acids adjacent to or outside of that groove.

Additional functionalities which may be engineered into modified CRISPR effector proteins as described herein include the following. 1. modified CRISPR effector proteins that disrupt DNA:protein interactions without affecting protein tertiary or secondary structure. This includes residues that contact any part of the RNA:DNA duplex. 2. modified CRISPR effector proteins that weaken intra-protein interactions holding C2c2 in conformation essential for nuclease cutting in response to DNA binding (on or off target). For example: a modification that mildly inhibits, but still allows, the nuclease conformation of the HNH domain (positioned at the scissile phosphate). 3. modified CRISPR effector proteins that strengthen intra-protein interactions holding C2c2 in a conformation inhibiting nuclease activity in response to DNA binding (on or off targets). For example: a modification that stabilizes the HNH domain in a conformation away from the scissile phosphate. Any such additional functional enhancement may be provided in combination with any other modification to the CRISPR effector protein as described in detail elsewhere herein.

Any of the herein described improved functionalities may be made to any CRISPR effector protein, such as a C2c2 effector protein. However, it will be appreciated that any of the functionalities described herein may be engineered into C2c2 effector proteins from other orthologs, including chimeric effector proteins comprising fragments from multiple orthologs.

The invention uses nucleic acids to bind target DNA sequences. This is advantageous as nucleic acids are much easier and cheaper to produce than proteins, and the specificity can be varied according to the length of the stretch where homology is sought. Complex 3-D positioning of multiple fingers, for example is not required. The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. As used herein the term "wild type" is a term of the art understood by skilled persons and means the typical form of an organism, strain, gene or characteristic as it occurs in nature as distinguished from mutant or variant forms. A "wild type" can be a base line. As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. "Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridizing to the reference sequence under highly stringent conditions. Generally, in order to maximize the hybridization rate, relatively low-stringency hybridization conditions are selected: about 20 to 25° C lower than the thermal melting point ($T_m$). The $T_m$ is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15° C. lower than the $T_m$. In order to require at least about 70% nucleotide complementarity of hybridized sequences, moderately-stringent washing conditions are selected to be about 15 to 30° C. lower than the $T_m$. Highly permissive (very low stringency) washing conditions may be as low as 50° C below the $T_m$, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42° C., or incubation in 5×SSC and 1% SDS at 65° C., with wash in 0.2×SSC and 0.1% SDS at 65° C. "Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life-eukaryotes (including multicellular organisms), pro-karyotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell. The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. As used herein, the term "domain" or "protein domain" refers to a part of a protein sequence that may exist and function independently of the rest of the protein chain. As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

In aspects of the invention the term "guide RNA", refers to the polynucleotide sequence comprising one or more of a putative or identified tracr sequence and a putative or identified crRNA sequence or guide sequence. In particular embodiments, the "guide RNA" comprises a putative or identified crRNA sequence or guide sequence. In further embodiments, the guide RNA does not comprise a putative or identified tracr sequence.

As used herein the term "wild type" is a term of the art understood by skilled persons and means the typical form of an organism, strain, gene or characteristic as it occurs in nature as distinguished from mutant or variant forms. A "wild type" can be a base line.

As used herein the term "variant" should be taken to mean the exhibition of qualities that have a pattern that deviates from what occurs in nature.

The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. In all aspects and embodiments, whether they include these terms or not, it will be understood that, preferably, the may be optional and thus preferably included or not preferably not included. Furthermore, the terms "non-naturally occurring" and "engineered" may be used interchangeably and so can therefore be used alone or in combination and one or other may replace mention of both together. In particular, "engineered" is preferred in place of "non-naturally occurring" or "non-naturally occurring and/or engineered."

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A.; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program. Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 Nuc. Acids Research 12 p387). Examples of other software than may perform sequence comparisons include, but are not limited to, the BLAST package (see Ausubel et al., 1999 Short Protocols in Molecular Biology, 4 Ed.—Chapter 18), FASTA (Altschul et al., 1990 J. Mol. Biol. 403-410) and the GENEWORKS suite of comparison tools. Both BLAST and FASTA are available for offline and online searching (see Ausubel et al., 1999, Short Protocols in Molecular Biology, pages 7-58 to 7-60). However, for some applications, it is preferred to use the GCG Bestfit program. A new tool, called BLAST 2 Sequences is also available for comparing protein and nucleotide sequences (see FEMS Microbiol Lett. 1999 174 (2): 247-50; FEMS Microbiol Lett. 1999 177(1): 187-8 and the website of the National Center for Biotechnology information at the website of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62. Alternatively, percentage homologies may be calculated using the multiple alignment feature in DNASIS™ (Hitachi Software), based on an algorithm, analogous to CLUSTAL (Higgins D G & Sharp P M (1988), Gene 73(1), 237-244). Once the software has produced an optimal alignment, it is possible to calculate % homology, preferably % sequence identity. The software typically does this as part of the sequence comparison and generates a numerical result. The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C. D. and Barton G. J. (1993) "Protein sequence alignments: a strategy for the hierarchical analysis of residue conservation" Comput. Appl. Biosci. 9: 745-756) (Taylor W. R. (1986) "The classification of amino acid conservation" J. Theor. Biol. 119; 205-218). Conservative substitutions may be made, for example according to the table below which describes a generally accepted Venn diagram grouping of amino acids.

TABLE 2

| Set | | Sub-set | |
|---|---|---|---|
| Hydrophobic | FWYHKMILVAGC | Aromatic | FWYH |
| | | Aliphatic | ILV |
| Polar | WYHKREDCSTNQ | Charged | HKRED |
| | | Positively charged | HKR |
| | | Negatively charged | ED |
| Small | VCAGSPTND | Tiny | AGS |

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R. I. Freshney, ed. (1987)).

Several aspects of the invention relate to vector systems comprising one or more vectors, or vectors as such. Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as Escherichia coli, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyriylalanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the a-carbon. Processes for preparing peptides in the peptoid form are known in the art, for example Simon R J et al., *PNAS* (1992) 89(20), 9367-9371 and Horwell D C, *Trends Biotechnol.* (1995) 13(4), 132-134.

Homology modelling: Corresponding residues in other C2c2 orthologs can be identified by the methods of Zhang et al., 2012 (Nature; 490(7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair a query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of the complex are created by superimposing the representative structures on their corresponding structural neighbor in the template. This approach is further described in Dey et al., 2013 (Prot Sci; 22: 359-66).

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of E. coli DNA polymerase, and reverse transcriptase. A preferred amplification method is PCR.

In certain aspects the invention involves vectors. A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

Aspects of the invention relate to bicistronic vectors for guide RNA and wild type, modified or mutated CRISPR effector proteins/enzymes (e.g. C2c2). Bicistronic expression vectors guide RNA and wild type, modified or mutated CRISPR effector proteins/enzymes (e.g. C2c2) are preferred. In general and particularly in this embodiment and wild type, modified or mutated CRISPR effector proteins/enzymes (e.g. C2c2) is preferably driven by the CBh promoter. The RNA may preferably be driven by a Pol III promoter, such as a U6 promoter. Ideally the two are combined.

In some embodiments, a loop in the guide RNA is provided. This may be a stem loop or a tetra loop. The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit p-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Vectors can be designed for expression of CRISPR transcripts (e.g., nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g., amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) *Gene* 69:301-315) and pET 11d (Studier et al., GENE EXPRESSION TECHNOLOGY: METHODS IN ENZYMOLOGY 185, Academic Press, San Diego, Calif. (1990) 60-89).

In some embodiments, a vector is a yeast expression vector. Examples of vectors for expression in yeast *Saccharomyces* cerivisae include pYepSecI (Baldari, et al., 1987. *EMBO J.* 6: 229-234), pMFa (Kuijan and Herskowitz, 1982. *Cell* 30: 933-943), pJRY88 (Schultz et al., 1987. *Gene* 54: 113-123), pYES2 (Invitrogen Corporation, San Diego, Calif.), and picZ (InVitrogen Corp, San Diego, Calif.).

In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156-2165) and the pVL series (Lucklow and Summers, 1989. *Virology* 170: 31-39).

In some embodiments, a vector is capable of driving expression of one or more sequences in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268-277), lymphoid-specific promoters (Calame and Eaton, 1988. *Adv. Immunol.* 43: 235-275), in particular promoters of T cell receptors (Winoto and Baltimore, 1989. *EMBO J.* 8: 729-733) and immunoglobulins (Baneiji, et al., 1983. *Cell* 33: 729-740; Queen and Baltimore, 1983. *Cell* 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science*

249: 374-379) and the α-fetoprotein promoter (Campes and Tilghman, 1989. *Genes Dev.* 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety.

In some embodiments, a regulatory element is operably linked to one or more elements of a CRISPR system so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli* (Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei, Streptococcus pyogenes, Anabaena*, and *Mycobacterium tuberculosis* (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to *Aeropyrum, Pyrobaculum, Sulfolobus, Archaeoglobus, Halocarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium, Azarcus, Chromobacterium, Neisseria, Nitrosomonas, Desulfovibrio, Geobacter, Myxococcus, Campylobacter, Wolinella, Acinetobacter, Erwinia, Escherichia, Legionella, Methylococcus, Pasteurella, Photobacterium, Salmonella, Xanthomonas, Yersinia, Treponema*, and *Thermotoga*.

In general, "nucleic acid-targeting system" as used in the present application refers collectively to transcripts and other elements involved in the expression of or directing the activity of nucleic acid-targeting CRISPR-associated ("Cas") genes (also referred to herein as an effector protein), including sequences encoding a nucleic acid-targeting Cas (effector) protein and a guide RNA (comprising crRNA sequence and a trans-activating CRISPR/Cas system RNA (tracrRNA) sequence), or other sequences and transcripts from a nucleic acid-targeting CRISPR locus. In some embodiments, one or more elements of a nucleic acid-targeting system are derived from a Type V/Type VI nucleic acid-targeting CRISPR system. In some embodiments, one or more elements of a nucleic acid-targeting system is derived from a particular organism comprising an endogenous nucleic acid-targeting CRISPR system. In general, a nucleic acid-targeting system is characterized by elements that promote the formation of a nucleic acid-targeting complex at the site of a target sequence. In the context of formation of a nucleic acid-targeting complex, "target sequence" refers to a sequence to which a guide sequence is designed to have complementarity, where hybridization between a target sequence and a guide RNA promotes the formation of a DNA or RNA-targeting complex. Full complementarity is not necessarily required, provided there is sufficient complementarity to cause hybridization and promote formation of a nucleic acid-targeting complex. A target sequence may comprise RNA polynucleotides. In some embodiments, a target sequence is located in the nucleus or cytoplasm of a cell. In some embodiments, the target sequence may be within an organelle of a eukaryotic cell, for example, mitochondrion or chloroplast. A sequence or template that may be used for recombination into the targeted locus comprising the target sequences is referred to as an "editing template" or "editing RNA" or "editing sequence". In aspects of the invention, an exogenous template RNA may be referred to as an editing template. In an aspect of the invention the recombination is homologous recombination.

Typically, in the context of an endogenous nucleic acid-targeting system, formation of a nucleic acid-targeting complex (comprising a guide RNA hybridized to a target sequence and complexed with one or more nucleic acid-targeting effector proteins) results in cleavage of one or both RNA strands in or near (e.g. within 1, 2, 3, 4, 5, 6, 7, 8, 9, 10, 20, 50, or more base pairs from) the target sequence. In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector protein and a guide RNA could each be operably linked to separate regulatory elements on separate vectors. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and a guide RNA embedded within one or more intron sequences (e.g. each in a different intron, two or more in at least one intron, or all in a single intron). In some embodiments, the nucleic acid-targeting effector protein and guide RNA are operably linked to and expressed from the same promoter.

In general, a guide sequence is any polynucleotide sequence having sufficient complementarity with a target polynucleotide sequence to hybridize with the target sequence and direct sequence-specific binding of a nucleic acid-targeting complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of a nucleic acid-targeting complex to a target sequence may be assessed by any suitable assay. For example, the components of a nucleic acid-targeting system sufficient to form a nucleic acid-targeting complex, including the guide sequence to be tested, may be provided to a host cell having the corresponding target sequence, such as by transfection with vectors encoding the components of the nucleic acid-targeting CRISPR sequence, followed by an assessment of preferential cleavage within or in the vicinity of the target sequence, such as by Surveyor assay as described herein. Similarly, cleavage of a target polynucleotide sequence (or a sequence in the vicinity thereof) may be evaluated in a test tube by providing the target sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art.

A guide sequence may be selected to target any target sequence. In some embodiments, the target sequence is a sequence within a gene transcript or mRNA.

In some embodiments, the target sequence is a sequence within a genome of a cell.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, Cell 106(1): 23-24; and PA Carr and GM Church, 2009, *Nature Biotechnology* 27(12): 1151-62). Further algorithms may be found in U.S. application Ser. No. 61/836,080; Broad Reference BI-2013/004A); incorporated herein by reference.

In some embodiments, the nucleic acid-targeting effector protein is part of a fusion protein comprising one or more heterologous protein domains (e.g., about or more than about 1, 2, 3, 4, 5, 6, 7, 8, 9, 10, or more domains in addition to the nucleic acid-targeting effector protein). In some embodiments, the CRISPR effector protein/enzyme is part of a fusion protein comprising one or more heterologous protein domains (e.g. about or more than about 1, 2, 3, 4, 5, 6, 7, 8, 9, 10, or more domains in addition to the CRISPR enzyme). A CRISPR effector protein/enzyme fusion protein may comprise any additional protein sequence, and optionally a linker sequence between any two domains. Examples of protein domains that may be fused to an effector protein include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A nucleic acid-targeting effector protein may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a nucleic acid-targeting effector protein are described in US20110059502, incorporated herein by reference. In some embodiments, a tagged nucleic acid-targeting effector protein is used to identify the location of a target sequence.

In some embodiments, a CRISPR enzyme may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283 and WO 2014/018423 and U.S. Pat. Nos. 8,889,418, 8,895,308, US20140186919, US20140242700, US20140273234, US20140335620, WO2014093635, which is hereby incorporated by reference in its entirety.

In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a nucleic acid-targeting effector protein in combination with (and optionally complexed with) a guide RNA is delivered to a cell. Conventional viral and non-viral based gene transfer methods can be used to introduce nucleic acids in mammalian cells or target tissues. Such methods can be used to administer nucleic acids encoding components of a nucleic acid-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Bohm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

Models of Genetic and Epigenetic Conditions

A method of the invention may be used to create a plant, an animal or cell that may be used to model and/or study genetic or epigenetic conditions of interest, such as a through a model of mutations of interest or a disease model. As used herein, "disease" refers to a disease, disorder, or indication in a subject. For example, a method of the invention may be used to create an animal or cell that comprises a modification in one or more nucleic acid sequences associated with a disease, or a plant, animal or cell in which the expression of one or more nucleic acid sequences associated with a disease are altered. Such a nucleic acid sequence may encode a disease associated protein sequence or may be a disease associated control sequence. Accordingly, it is understood that in embodiments of the invention, a plant, subject, patient, organism or cell can be a non-human subject, patient, organism or cell. Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants. In the instance where the cell is in cultured, a cell line may be established if appropriate culturing conditions are met and preferably if the cell is suitably adapted for this purpose (for instance a stem cell). Bacterial cell lines produced by the invention are also envisaged. Hence, cell lines are also envisaged.

In some methods, the disease model can be used to study the effects of mutations on the animal or cell and development and/or progression of the disease using measures commonly used in the study of the disease. Alternatively, such a disease model is useful for studying the effect of a pharmaceutically active compound on the disease.

In some methods, the disease model can be used to assess the efficacy of a potential gene therapy strategy. That is, a disease-associated gene or polynucleotide can be modified such that the disease development and/or progression is inhibited or reduced. In particular, the method comprises modifying a disease-associated gene or polynucleotide such that an altered protein is produced and, as a result, the animal or cell has an altered response. Accordingly, in some methods, a genetically modified animal may be compared with an animal predisposed to development of the disease such that the effect of the gene therapy event may be assessed.

In another embodiment, this invention provides a method of developing a biologically active agent that modulates a cell signaling event associated with a disease gene. The method comprises contacting a test compound with a cell comprising one or more vectors that drive expression of one or more of a CRISPR enzyme, and a direct repeat sequence linked to a guide sequence; and detecting a change in a readout that is indicative of a reduction or an augmentation of a cell signaling event associated with, e.g., a mutation in a disease gene contained in the cell.

A cell model or animal model can be constructed in combination with the method of the invention for screening a cellular function change. Such a model may be used to study the effects of a genome sequence modified by the CRISPR complex of the invention on a cellular function of interest. For example, a cellular function model may be used to study the effect of a modified genome sequence on intracellular signaling or extracellular signaling. Alternatively, a cellular function model may be used to study the effects of a modified genome sequence on sensory perception. In some such models, one or more genome sequences associated with a signaling biochemical pathway in the model are modified.

Several disease models have been specifically investigated. These include de novo autism risk genes CHD8, KATNAL2, and SCN2A; and the syndromic autism (Angelman Syndrome) gene UBE3A. These genes and resulting autism models are of course preferred, but serve to show the broad applicability of the invention across genes and corresponding models.

An altered expression of one or more genome sequences associated with a signalling biochemical pathway can be determined by assaying for a difference in the mRNA levels of the corresponding genes between the test model cell and a control cell, when they are contacted with a candidate agent. Alternatively, the differential expression of the sequences associated with a signaling biochemical pathway is determined by detecting a difference in the level of the encoded polypeptide or gene product.

To assay for an agent-induced alteration in the level of mRNA transcripts or corresponding polynucleotides, nucleic acid contained in a sample is first extracted according to standard methods in the art. For instance, mRNA can be isolated using various lytic enzymes or chemical solutions according to the procedures set forth in Sambrook et al. (1989), or extracted by nucleic-acid-binding resins following the accompanying instructions provided by the manufacturers. The mRNA contained in the extracted nucleic acid sample is then detected by amplification procedures or conventional hybridization assays (e.g. Northern blot analysis) according to methods widely known in the art or based on the methods exemplified herein.

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of E. coli DNA polymerase, and reverse transcriptase. A preferred amplification method is PCR. In particular, the isolated RNA can be subjected to a reverse transcription assay that is coupled with a quantitative polymerase chain reaction (RT-PCR) in order to quantify the expression level of a sequence associated with a signaling biochemical pathway.

Detection of the gene expression level can be conducted in real time in an amplification assay. In one aspect, the amplified products can be directly visualized with fluorescent DNA-binding agents including but not limited to DNA intercalators and DNA groove binders. Because the amount of the intercalators incorporated into the double-stranded DNA molecules is typically proportional to the amount of the amplified DNA products, one can conveniently determine the amount of the amplified products by quantifying the fluorescence of the intercalated dye using conventional optical systems in the art. DNA-binding dye suitable for this application include SYBR green, SYBR blue, DAPI, propidium iodine, Hoeste, SYBR gold, ethidium bromide, acridines, proflavine, acridine orange, acriflavine, fluorocoumanin, ellipticine, daunomycin, chloroquine, distamycin D, chromomycin, homidium, mithramycin, ruthenium polypyridyls, anthramycin, and the like.

In another aspect, other fluorescent labels such as sequence specific probes can be employed in the amplification reaction to facilitate the detection and quantification of the amplified products. Probe-based quantitative amplification relies on the sequence-specific detection of a desired amplified product. It utilizes fluorescent, target-specific probes (e.g., TaqMan® probes) resulting in increased specificity and sensitivity. Methods for performing probe-based quantitative amplification are well established in the art and are taught in U.S. Pat. No. 5,210,015.

In yet another aspect, conventional hybridization assays using hybridization probes that share sequence homology with sequences associated with a signaling biochemical pathway can be performed. Typically, probes are allowed to form stable complexes with the sequences associated with a signaling biochemical pathway contained within the biological sample derived from the test subject in a hybridization reaction. It will be appreciated by one of skill in the art that where antisense is used as the probe nucleic acid, the target polynucleotides provided in the sample are chosen to be complementary to sequences of the antisense nucleic acids. Conversely, where the nucleotide probe is a sense nucleic acid, the target polynucleotide is selected to be complementary to sequences of the sense nucleic acid.

Hybridization can be performed under conditions of various stringency. Suitable hybridization conditions for the practice of the present invention are such that the recognition interaction between the probe and sequences associated with a signaling biochemical pathway is both sufficiently specific and sufficiently stable. Conditions that increase the stringency of a hybridization reaction are widely known and published in the art. See, for example, (Sambrook, et al., (1989); Nonradioactive In Situ Hybridization Application Manual, Boehringer Mannheim, second edition). The hybridization assay can be formed using probes immobilized on any solid support, including but are not limited to nitrocellulose, glass, silicon, and a variety of gene arrays. A preferred hybridization assay is conducted on high-density gene chips as described in U.S. Pat. No. 5,445,934.

For a convenient detection of the probe-target complexes formed during the hybridization assay, the nucleotide probes are conjugated to a detectable label. Detectable labels suitable for use in the present invention include any composition detectable by photochemical, biochemical, spectroscopic, immunochemical, electrical, optical or chemical means. A wide variety of appropriate detectable labels are known in the art, which include fluorescent or chemiluminescent labels, radioactive isotope labels, enzymatic or other ligands. In preferred embodiments, one will likely desire to employ a fluorescent label or an enzyme tag, such as digoxigenin, B-galactosidase, urease, alkaline phosphatase or peroxidase, avidin/biotin complex.

The detection methods used to detect or quantify the hybridization intensity will typically depend upon the label selected above. For example, radiolabels may be detected using photographic film or a phosphoimager. Fluorescent markers may be detected and quantified using a photodetector to detect emitted light. Enzymatic labels are typically detected by providing the enzyme with a substrate and measuring the reaction product produced by the action of the enzyme on the substrate; and finally colorimetric labels are detected by simply visualizing the colored label.

An agent-induced change in expression of sequences associated with a signaling biochemical pathway can also be determined by examining the corresponding gene products. Determining the protein level typically involves a) contacting the protein contained in a biological sample with an agent that specifically bind to a protein associated with a signaling biochemical pathway; and (b) identifying any agent:protein complex so formed. In one aspect of this embodiment, the agent that specifically binds a protein associated with a signaling biochemical pathway is an antibody, preferably a monoclonal antibody.

The reaction is performed by contacting the agent with a sample of the proteins associated with a signaling biochemical pathway derived from the test samples under conditions that will allow a complex to form between the agent and the proteins associated with a signaling biochemical pathway. The formation of the complex can be detected directly or indirectly according to standard procedures in the art. In the direct detection method, the agents are supplied with a detectable label and unreacted agents may be removed from the complex; the amount of remaining label thereby indicating the amount of complex formed. For such method, it is preferable to select labels that remain attached to the agents even during stringent washing conditions. It is preferable that the label does not interfere with the binding reaction. In the alternative, an indirect detection procedure may use an agent that contains a label introduced either chemically or enzymatically. A desirable label generally does not interfere with binding or the stability of the resulting agent:polypeptide complex. However, the label is typically designed to be accessible to an antibody for an effective binding and hence generating a detectable signal.

A wide variety of labels suitable for detecting protein levels are known in the art. Non-limiting examples include radioisotopes, enzymes, colloidal metals, fluorescent compounds, bioluminescent compounds, and chemiluminescent compounds.

The amount of agent:polypeptide complexes formed during the binding reaction can be quantified by standard quantitative assays. As illustrated above, the formation of agent:polypeptide complex can be measured directly by the amount of label remained at the site of binding. In an alternative, the protein associated with a signaling biochemical pathway is tested for its ability to compete with a labeled analog for binding sites on the specific agent. In this competitive assay, the amount of label captured is inversely proportional to the amount of protein sequences associated with a signaling biochemical pathway present in a test sample.

A number of techniques for protein analysis based on the general principles outlined above are available in the art. They include but are not limited to radioimmunoassays, ELISA (enzyme linked immunoradiometric assays), "sandwich" immunoassays, immunoradiometric assays, in situ immunoassays (using e.g., colloidal gold, enzyme or radioisotope labels), western blot analysis, immunoprecipitation assays, immunofluorescent assays, and SDS-PAGE.

Antibodies that specifically recognize or bind to proteins associated with a signaling biochemical pathway are preferable for conducting the aforementioned protein analyses. Where desired, antibodies that recognize a specific type of post-translational modifications (e.g., signaling biochemical pathway inducible modifications) can be used. Post-translational modifications include but are not limited to glycosylation, lipidation, acetylation, and phosphorylation. These antibodies may be purchased from commercial vendors. For example, anti-phosphotyrosine antibodies that specifically recognize tyrosine-phosphorylated proteins are available from a number of vendors including Invitrogen and Perkin Elmer. Antiphosphotyrosine antibodies are particularly useful in detecting proteins that are differentially phosphorylated on their tyrosine residues in response to an ER stress. Such proteins include but are not limited to eukaryotic translation initiation factor 2 alpha (eIF-2a). Alternatively, these antibodies can be generated using conventional polyclonal or monoclonal antibody technologies by immunizing a host animal or an antibody-producing cell with a target protein that exhibits the desired post-translational modification.

In practicing the subject method, it may be desirable to discern the expression pattern of an protein associated with a signaling biochemical pathway in different bodily tissue, in different cell types, and/or in different subcellular structures. These studies can be performed with the use of tissue-specific, cell-specific or subcellular structure specific antibodies capable of binding to protein markers that are preferentially expressed in certain tissues, cell types, or subcellular structures.

An altered expression of a gene associated with a signaling biochemical pathway can also be determined by examining a change in activity of the gene product relative to a control cell. The assay for an agent-induced change in the activity of a protein associated with a signaling biochemical pathway will dependent on the biological activity and/or the signal transduction pathway that is under investigation. For example, where the protein is a kinase, a change in its ability to phosphorylate the downstream substrate(s) can be determined by a variety of assays known in the art. Representative assays include but are not limited to immunoblotting and immunoprecipitation with antibodies such as anti-phosphotyrosine antibodies that recognize phosphorylated proteins. In addition, kinase activity can be detected by high throughput chemiluminescent assays such as AlphaScreen™ (available from Perkin Elmer) and eTag™ assay (Chan-Hui, et al. (2003) Clinical Immunology 111: 162-174).

Where the protein associated with a signaling biochemical pathway is part of a signaling cascade leading to a fluctuation of intracellular pH condition, pH sensitive molecules such as fluorescent pH dyes can be used as the reporter molecules. In another example where the protein associated with a signaling biochemical pathway is an ion channel, fluctuations in membrane potential and/or intracellular ion concentration can be monitored. A number of commercial kits and high-throughput devices are particularly suited for a rapid and robust screening for modulators of ion channels. Representative instruments include FLIPR™ (Molecular Devices, Inc.) and VIPR (Aurora Biosciences). These instruments are capable of detecting reactions in over 1000 sample wells of a microplate simultaneously, and providing real-time measurement and functional data within a second or even a minisecond.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA).

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA). Without wishing to be bound by theory, it is believed that the target sequence should be associated with a PAM (protospacer adjacent motif); that is, a short sequence recognized by the CRISPR complex. The precise sequence and length requirements for the PAM differ depending on the CRISPR enzyme used, but PAMs are typically 2-5 base pair sequences adjacent the protospacer (that is, the target sequence) Examples of PAM sequences are given in the examples section below, and the skilled person will be able to identify further PAM sequences for use with a given CRISPR enzyme.

The target polynucleotide of a CRISPR complex may include a number of disease associated genes and polynucleotides as well as signaling biochemical pathway-associated genes and polynucleotides as listed in U.S. provisional patent applications 61/736,527 and 61/748,427 both entitled SYSTEMS METHODS AND COMPOSITIONS FOR SEQUENCE MANIPULATION filed on Dec. 12, 2012 and Jan. 2, 2013, respectively, and PCT Application PCT/US2013/074667, entitled DELIVERY, ENGINEERING AND OPTIMIZATION OF SYSTEMS, METHODS AND COMPOSITIONS FOR SEQUENCE MANIPULATION AND THERAPEUTIC APPLICATIONS, filed Dec. 12, 2013, the contents of all of which are herein incorporated by reference in their entirety.

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

Genome Wide Knock-Out Screening

The CRISPR effector protein complexes described herein can be used to perform efficient and cost effective functional genomic screens. Such screens can utilize CRISPR effector protein based genome wide libraries. Such screens and libraries can provide for determining the function of genes, cellular pathways genes are involved in, and how any alteration in gene expression can result in a particular biological process. An advantage of the present invention is that the CRISPR system avoids off-target binding and its resulting side effects. This is achieved using systems arranged to have a high degree of sequence specificity for the target DNA. In preferred embodiments of the invention, the CRISPR effector protein complexes are C2c2 effector protein complexes.

In embodiments of the invention, a genome wide library may comprise a plurality of C2c2 guide RNAs, as described herein, comprising guide sequences that are capable of targeting a plurality of target sequences in a plurality of genomic loci in a population of eukaryotic cells. The population of cells may be a population of embryonic stem (ES) cells. The target sequence in the genomic locus may be a non-coding sequence. The non-coding sequence may be an intron, regulatory sequence, splice site, 3' UTR, 5' UTR, or polyadenylation signal. Gene function of one or more gene products may be altered by said targeting. The targeting may result in a knockout of gene function. The targeting of a gene product may comprise more than one guide RNA. A gene product may be targeted by 2, 3, 4, 5, 6, 7, 8, 9, or 10 guide RNAs, preferably 3 to 4 per gene. Off-target modifications may be minimized by exploiting the staggered double strand breaks generated by C2c2 effector protein complexes or by utilizing methods analogous to those used in CRISPR-Cas9 systems (See, e.g., DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013)), incorporated herein by reference. The targeting may be of about 100 or more sequences. The targeting may be of about 1000 or more sequences. The targeting may be of about 20,000 or more sequences. The targeting may be of the entire genome. The targeting may be of a panel of target sequences focused on a relevant or desirable pathway. The pathway may be an immune pathway. The pathway may be a cell division pathway.

One aspect of the invention comprehends a genome or transcriptome wide library that may comprise a plurality of C2c2 guide RNAs that may comprise guide sequences that are capable of targeting a plurality of target sequences in a plurality of (genomic) loci, wherein said targeting results in a knockout/knockdown of gene function. This library may potentially comprise guide RNAs that target each and every gene in the genome of an organism.

In some embodiments of the invention the organism or subject is a eukaryote (including mammal including human) or a non-human eukaryote or a non-human animal or a non-human mammal. In some embodiments, the organism or subject is a non-human animal, and may be an arthropod, for example, an insect, or may be a nematode. In some methods of the invention the organism or subject is a plant. In some methods of the invention the organism or subject is a mammal or a non-human mammal. A non-human mammal may be for example a rodent (preferably a mouse or a rat), an ungulate, or a primate. In some methods of the invention the organism or subject is algae, including microalgae, or is a fungus.

The knockout/knockdown of gene function may comprise: introducing into each cell in the population of cells a vector system of one or more vectors comprising an engineered, non-naturally occurring C2c2 effector protein system comprising I. a C2c2 effector protein, and II. one or more guide RNAs, wherein components I and II may be same or on different vectors of the system, integrating components I and II into each cell, wherein the guide sequence targets a unique gene in each cell, wherein the C2c2 effector protein is operably linked to a regulatory element, wherein when transcribed, the guide RNA comprising the guide sequence directs sequence-specific binding of the C2c2 effector protein system to a target sequence corresponding to the genomic loci of the unique gene, inducing cleavage of the RNA corresponding to said genomic loci by the C2c2 effector protein, and confirming different knockdown events in a plurality of unique genes in each cell of the population of cells thereby generating a gene knockdown cell library. The invention comprehends that the population of cells is a population of eukaryotic cells, and in a preferred embodiment, the population of cells is a population of embryonic stem (ES) cells.

The one or more vectors may be plasmid vectors. The vector may be a single vector comprising a C2c2 effector protein, a sgRNA, and optionally, a selection marker into target cells. Not being bound by a theory, the ability to simultaneously deliver a C2c2 effector protein and sgRNA through a single vector enables application to any cell type of interest, without the need to first generate cell lines that express the C2c2 effector protein. The regulatory element may be an inducible promoter. The inducible promoter may be a doxycycline inducible promoter. In some methods of the invention the expression of the guide sequence is under the control of the T7 promoter and is driven by the expression of T7 polymerase. The confirming of different knockdown events may be by whole transcriptome sequencing. The knockout mutation may be achieved in 100 or more unique genes. The knockdown event may be achieved in 1000 or more unique genes. The knockdown event may be achieved in 20,000 or more unique genes. The knockdown event may be achieved in the entire genome. The knockdown of gene function may be achieved in a plurality of unique genes which function in a particular physiological pathway or condition. The pathway or condition may be an immune pathway or condition. The pathway or condition may be a cell division pathway or condition.

The invention also provides kits that comprise the transcriptome wide libraries mentioned herein. The kit may comprise a single container comprising vectors or plasmids comprising the library of the invention. The kit may also comprise a panel comprising a selection of unique C2c2 effector protein system guide RNAs comprising guide sequences from the library of the invention, wherein the selection is indicative of a particular physiological condition. The invention comprehends that the targeting is of about 100 or more sequences, about 1000 or more sequences or about 20,000 or more sequences or the entire transcriptome. Furthermore, a panel of target sequences may be focused on a relevant or desirable pathway, such as an immune pathway or cell division.

In an additional aspect of the invention, the C2c2 effector protein may comprise one or more mutations and may be used as a generic RNA binding protein with or without fusion to a functional domain. The mutations may be artificially introduced mutations or gain- or loss-of-function mutations. The mutations have been characterized as described herein. In one aspect of the invention, the functional domain may be a transcriptional activation domain, which may be VP64. In other aspects of the invention, the functional domain may be a transcriptional repressor domain, which may be KRAB or SID4X. Other aspects of the invention relate to the mutated C2c2 effector protein being fused to domains which include but are not limited to a transcriptional activator, repressor, a recombinase, a transposase, a histone remodeler, a demethylase, a DNA methyltransferase, a cryptochrome, a light inducible/controllable domain or a chemically inducible/controllable domain. Some methods of the invention can include inducing expression of targeted genes. In one embodiment, inducing expression by targeting a plurality of target sequences in a plurality of genomic loci in a population of eukaryotic cells is by use of a functional domain.

Useful in the practice of the instant invention utilizing C2c2 3 effector protein complexes are methods used in CRISPR-Cas9 systems and reference is made to: Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, BL., Root, D E., Doench, J G., Zhang, F. Science December 12. (2013). [Epub ahead of print]; Published in final edited form as: Science. 2014 Jan. 3; 343(6166): 84-87.

Shalem et al. involves a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hitsNF2, CUL3, TADA2B, and TADAL. The authors observed a high level of consistency between independent guide RNAs targeting the same gene and a high rate of hit confirmation, and thus demonstrated the promise of genome-scale screening with Cas9.

Reference is also made to US patent publication number US20140357530; and PCT Patent Publication WO2014093701, hereby incorporated herein by reference.

Functional Alteration and Screening

In another aspect, the present invention provides for a method of functional evaluation and screening of genes. The use of the CRISPR system of the present invention to precisely deliver functional domains, to activate or repress genes or to alter epigenetic state by precisely altering the methylation site on a specific locus of interest, can be with one or more guide RNAs applied to a single cell or population of cells or with a library applied to genome in a pool of cells ex vivo or in vivo comprising the administration or expression of a library comprising a plurality of guide RNAs (sgRNAs) and wherein the screening further comprises use of a C2c2 effector protein, wherein the CRISPR complex comprising the C2c2 effector protein is modified to comprise a heterologous functional domain. In an aspect the invention provides a method for screening a genome/transcriptome comprising the administration to a host or expression in a host in vivo of a library. In an aspect the invention provides a method as herein discussed further comprising an activator administered to the host or expressed in the host. In an aspect the invention provides a method as herein discussed wherein the activator is attached to a C2c2 effector protein. In an aspect the invention provides a method as herein discussed wherein the activator is attached to the N terminus or the C terminus of the C2c2 effector protein. In an aspect the invention provides a method as herein discussed wherein the activator is attached to a sgRNA loop. In an aspect the invention provides a method as herein discussed further comprising a repressor administered to the host or expressed in the host. In an aspect the invention provides a method as herein discussed, wherein the screening comprises affecting and detecting gene activation, gene inhibition, or cleavage in the locus.

In an aspect, the invention provides efficient on-target activity and minimizes off target activity. In an aspect, the invention provides efficient on-target cleavage by C2c2 effector protein and minimizes off-target cleavage by the C2c2 effector protein. In an aspect, the invention provides guide specific binding of C2c2 effector protein at a locus without DNA cleavage. Accordingly, in an aspect, the invention provides target-specific gene regulation. In an aspect, the invention provides guide specific binding of C2c2 effector protein at a gene locus without DNA cleavage. Accordingly, in an aspect, the invention provides for cleavage at one locus and gene regulation at a different locus using a single C2c2 effector protein. In an aspect, the invention provides orthogonal activation and/or inhibition and/or cleavage of multiple targets using one or more C2c2 effector protein and/or enzyme.

In an aspect the invention provides a method as herein discussed, wherein the host is a eukaryotic cell. In an aspect the invention provides a method as herein discussed, wherein the host is a mammalian cell. In an aspect the invention provides a method as herein discussed, wherein the host is a non-human eukaryote. In an aspect the invention provides a method as herein discussed, wherein the non-human eukaryote is a non-human mammal. In an aspect the invention provides a method as herein discussed, wherein the non-human mammal is a mouse. An aspect the invention provides a method as herein discussed comprising the delivery of the C2c2 effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein discussed wherein the expressing in vivo is via a lentivirus, an adenovirus, or an AAV. In an aspect the invention provides a method as herein discussed wherein the delivery is via a particle, a nanoparticle, a lipid or a cell penetrating peptide (CPP).

In an aspect the invention provides a pair of CRISPR complexes comprising C2c2 effector protein, each comprising a guide RNA (sgRNA) comprising a guide sequence capable of hybridizing to a target sequence in a genomic locus of interest in a cell, wherein at least one loop of each sgRNA is modified by the insertion of distinct RNA sequence(s) that bind to one or more adaptor proteins, and wherein the adaptor protein is associated with one or more functional domains, wherein each sgRNA of each C2c2 effector protein complex comprises a functional domain having a DNA cleavage activity. In an aspect the invention provides paired C2C1 or C2c3 effector protein complexes as herein-discussed, wherein the DNA cleavage activity is due to a Fok1 nuclease.

In an aspect the invention provides a method for cutting a target sequence in a genomic locus of interest comprising delivery to a cell of the C2c2 effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein-discussed wherein the delivery is via a lentivirus, an adenovirus, or an AAV. In an aspect the invention provides a method as herein-discussed or paired C2c2 effector protein complexes as herein-discussed wherein the target sequence for a first complex of the pair is on a first strand of double stranded DNA and the target sequence for a second complex of the pair is on a second strand of double stranded DNA. In an aspect the invention provides a method as herein-discussed or paired C2c2 effector protein complexes as herein-discussed wherein the target sequences of the first and second complexes are in proximity to each other such that the DNA is cut in a manner that facilitates homology directed repair. In an aspect a herein method can further include introducing into the cell template DNA. In an aspect a herein method or herein paired C2c2 effector protein complexes can involve wherein each C2c2 effector protein complex has a C2c2 effector enzyme that is mutated such that it has no more than about 5% of the nuclease activity of the C2c2 effector enzyme that is not mutated.

In an aspect the invention provides a library, method or complex as herein-discussed wherein the sgRNA is modified to have at least one non-coding functional loop, e.g., wherein the at least one non-coding functional loop is repressive; for instance, wherein the at least one non-coding functional loop comprises Alu.

In one aspect, the invention provides a method for altering or modifying expression of a gene product. The said method may comprise introducing into a cell containing and expressing a DNA molecule encoding the gene product an engineered, non-naturally occurring CRISPR system comprising a C2c2 effector protein and guide RNA that targets the DNA molecule, whereby the guide RNA targets the DNA molecule encoding the gene product and the C2c2 effector protein cleaves the DNA molecule encoding the gene product, whereby expression of the gene product is altered; and, wherein the C2c2 effector protein and the guide RNA do not naturally occur together. The invention comprehends the guide RNA comprising a guide sequence linked to a direct repeat sequence. The invention further comprehends the C2c2 effector protein being codon optimized for expression in a Eukaryotic cell. In a preferred embodiment the Eukaryotic cell is a mammalian cell and in a more preferred embodiment the mammalian cell is a human cell. In a further embodiment of the invention, the expression of the gene product is decreased.

In some embodiments, one or more functional domains are associated with the C2c2 effector protein. In some embodiments, one or more functional domains are associated with an adaptor protein, for example as used with the modified guides of Konnerman et al. (Nature 517, 583-588, 29 Jan. 2015). In some embodiments, one or more functional domains are associated with an dead sgRNA (dRNA). In some embodiments, a dRNA complex with active C2c2 effector protein directs gene regulation by a functional domain at on gene locus while an sgRNA directs DNA cleavage by the active C2c2 effector protein at another locus, for example as described analogously in CRISPR-Cas9 systems by Dahlman et al., 'Orthogonal gene control with a catalytically active Cas9 nuclease' (in press). In some embodiments, dRNAs are selected to maximize selectivity of regulation for a gene locus of interest compared to off-target regulation. In some embodiments, dRNAs are selected to maximize target gene regulation and minimize target cleavage For the purposes of the following discussion, reference to a functional domain could be a functional domain associated with the C2c2 effector protein or a functional domain associated with the adaptor protein.

In some embodiments, the one or more functional domains is an NLS (Nuclear Localization Sequence) or an NES (Nuclear Export Signal). In some embodiments, the one or more functional domains is a transcriptional activation domain comprises VP64, p65, MyoDl, HSF1, RTA, SET7/9 and a histone acetyltransferase. Other references herein to activation (or activator) domains in respect of those associated with the CRISPR enzyme include any known transcriptional activation domain and specifically VP64, p65, MyoD, HSF1, RTA, SET7/9 or a histone acetyltransferase.

In some embodiments, the one or more functional domains is a transcriptional repressor domain. In some embodiments, the transcriptional repressor domain is a KRAB domain. In some embodiments, the transcriptional repressor domain is a NuE domain, NcoR domain, SID domain or a SID4X domain.

In some embodiments, the one or more functional domains have one or more activities comprising translation activation activity, translation repression activity, methylase activity, demethylase activity, transcription activation activity, transcription repression activity, transcription release factor activity, histone modification activity, RNA cleavage activity, DNA cleavage activity, DNA integration activity or nucleic acid binding activity.

Histone modifying domains are also preferred in some embodiments. Exemplary histone modifying domains are discussed below. Transposase domains, HR (Homologous Recombination) machinery domains, recombinase domains, and/or integrase domains are also preferred as the present functional domains. In some embodiments, DNA integration activity includes HR machinery domains, integrase domains, recombinase domains and/or transposase domains. Histone acetyltransferases are preferred in some embodiments.

In some embodiments, the DNA cleavage activity is due to a nuclease. In some embodiments, the nuclease comprises a Fok1 nuclease. See, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In some embodiments, the one or more functional domains is attached to the C2c2 effector protein so that upon binding to the sgRNA and target the functional domain is in a spatial orientation allowing for the functional domain to function in its attributed function.

In some embodiments, the one or more functional domains is attached to the adaptor protein so that upon binding of the C2c2 effector protein to the sgRNA and target, the functional domain is in a spatial orientation allowing for the functional domain to function in its attributed function.

In an aspect the invention provides a composition as herein discussed wherein the one or more functional domains is attached to the C2c2 effector protein or adaptor protein via a linker, optionally a GlySer linker, as discussed herein.

Endogenous transcriptional repression is often mediated by chromatin modifying enzymes such as histone methyltransferases (HMTs) and deacetylases (HDACs). Repressive histone effector domains are known and an exemplary list is provided below. In the exemplary table, preference was given toproteinsand functional truncations ofsmallsizetofacilitate efficient viral packaging (for instance via AAV). In general, however, the domains may include HDACs, histone methyltransferases (HMTs), and histone acetyltransferase (HAT) inhibitors, as well as HDAC and HMT recruiting proteins. The functional domain may beor include, in some embodiments, HDAC Effector Domains, HDAC Recruiter Effector Domains, Histone Methyltransferase (HMT) Effector Domains, Histone Methyltransferase (HMT) Recruiter Effector Domains, or Histone Acetyltransferase Inhibitor Effector Domains.

TABLE 3

HDAC Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| HDAC I | HDAC8 | — | — | X. laevis | 325 | 1-325 | 325 | 1-272: HDAC |
| HDAC I | RPD3 | — | — | S. cerevisiae | 433 | 19-340 | 322 (Vannier) | 19-331: HDAC |
| HDAC IV | MesoLo4 | — | — | M. loti | 300 | 1-300 (Gregoretti) | 300 | — |
| HDAC IV | HDAC11 | — | — | H. sapiens | 347 | 1-347 (Gao) | 347 | 14-326: HDAC |
| HD2 | HDT1 | — | — | A. thaliana | 245 | 1-211 (Wu) | 211 | — |
| SIRT I | SIRT3 | H3K9Ac H4K16Ac H3K56Ac | — | H. sapiens | 399 | 143-399 (Scher) | 257 | 126-382: SIRT |
| SIRT I | HST2 | — | — | C. albicans | 331 | 1-331 (Hnisz) | 331 | — |
| SIRT I | CobB | — | — | E. coli (K12) | 242 | 1-242 (Landry) | 242 | — |
| SIRT I | HST2 | — | — | S. cerevisiae | 357 | 8-298 (Wilson) | 291 | — |
| SIRT III | SIRT5 | H4K8Ac H4K16Ac | — | H. sapiens | 310 | 37-310 (Gertz) | 274 | 41-309: SIRT |
| SIRT III | Sir2A | — | — | P. falciparum | 273 | 1-273 (Zhu) | 273 | 19-273: SIRT |
| SIRT IV | SIRT6 | H3K9Ac H3K56Ac | — | H. sapiens | 355 | 1-289 (Tennen) | 289 | 35-274: SIRT |

Accordingly, the repressor domains of the present invention may be selected from histone methyltransferases (HMTs), histone deacetylases (HDACs), histone acetyltransferase (HAT) inhibitors, as well as HDAC and HMT recruiting proteins.

The HDAC domain may be any of those in the table above, namely: HDAC8, RPD3, MesoLo4, HDAC11, HDT1, SIRT3, HST2, CobB, HST2, SIRT5, Sir2A, or SIRT6.

In some embodiment, the functional domain may be a HDAC Recruiter Effector Domain. Preferred examples include those in the Table below, namely MCCP2, MBD2b, Sin3a, NcoR, SALL1, RCORL. NcoR is exemplified in the present Examples and, although preferred, it is envisaed that others in the class will also be useful.

TABLE 4

HDAC Recruiter Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| Sin3a | MeCP2 | — | — | R. norvegicus | 492 | 207-492 (Nan) | 286 | — |
| Sin3a | MBD2b | — | — | H. sapiens | 262 | 45-262 (Boeke) | 218 | — |
| Sin3a | Sin3a | — | — | H. sapiens | 1273 | 524-851 (Laherty) | 328 | 627-829: HDAC1 interaction |
| NcoR | NcoR | — | — | H. sapiens | 2440 | 420-488 (Zhang) | 69 | — |
| NuRD | SALL1 | — | — | M. musculus | 1322 | 1-93 (Lauberth) | 93 | — |
| CoREST | RCOR1 | — | — | H. sapiens | 482 | 81-300 (Gu, Ouyang) | 220 | — |

In some embodiment, the functional domain may be aMethyltransferase (HMT) Effector Domain. Preferred examples include those in the Table below, namely NUE, vSET, EHMT2/G9A, SUV39H1, dim-5, KYP, SUVR4, SET4, SET, SETD8, and TgSET8. NUE is exemplified in the present Examples and, although preferred, it is envisaged that others in the class will also be useful.

TABLE 5

Histone Methyltransferase (HMT) Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| SET | NUE | H2B, H3, H4 | — | C. trachomatis | 219 | 1-219 (Pennini) | 219 | — |
| SET | vSET | — | H3K27me3 | P. bursaria chlorella virus | 119 | 1-119 (Mujtaba) | 119 | 4-112: SET2 |
| SUV39 family | EHMT2/G9A | H1.4K2, H3K9, H3K27 | H3K9me1/2, H1K25me1 | M. musculus | 1263 | 969-1263 (Tachibana) | 295 | 1025-1233: preSET, SET, postSET |
| SUV39 | SUV39H1 | — | H3K9me2/3 | H. sapiens | 412 | 79-412 (Snowden) | 334 | 172-412: preSET, SET, postSET |
| Suvar3-9 | dim-5 | — | H3K9me3 | N. crassa | 331 | 1-331 (Rathert) | 331 | 77-331: preSET, SET, postSET |
| Suvar3-9 (SUVH subfamily) | KYP | — | H3K9me1/2 | A. thaliana | 624 | 335-601 | 267 (Jackson) | — |
| Suvar3-9 (SUVR subfamily) | SUVR4 | H3K9me1 | H3K9me2/3 | A. thaliana | 492 | 180-492 | 313 (Thorstensen) | 192-462: preSET, SET, postSET |
| Suvar4-20 | SET4 | — | H4K20me3 | C. elegans | 288 | 1-288 (Vielle) | 288 | — |
| SET8 | SET1 | — | H4K20me1 | C. elegans | 242 | 1-242 (Vielle) | 242 | — |
| SET8 | SETD8 | — | H4K20me1 | H. sapiens | 393 | 185-393 (Couture) | 209 | 256-382: SET |
| SET8 | TgSET8 | — | H4K20me1/2/3 | T. gondii | 1893 | 1590-1893 (Sautel) | 304 | 1749-1884: SET |

In some embodiment, the functional domain may be a Histone Methyltransferase (HMT) Recruiter Effector Domain. Preferred examples include those in the Table below, namely Hp1a, PHF19, and NIPP1.

TABLE 6

Histone Methyltransferase (HMT) Recruiter Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| — | Hp1a | — | H3K9me3 | M. musculus | 191 | 73-191 | 119 (Hathaway) | 121-179: chromoshadow |
| — | PHF19 | — | H3K27me3 | H. sapiens | 580 | (1-250) + GGSG linker (SEQ ID NO: 49) + (500-580) | 335 (Ballaré) | 163-250: PHD2 |
| — | NIPP1 | — | H3K27me3 | H. sapiens | 351 | 1-329 (Jin) | 329 | 310-329: EED |

In some embodiment, the functional domain may be Histone Acetyltransferase Inhibitor Effector Domain. Preferred examples include SET/TAF-1p listed in the Table below.

TABLE 7

Histone Acetyltransferase Inhibitor Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| — | SET/TAF-1β | — | — | M. musculus | 289 | 1-289 (Cervoni) | 289 | — |

It is also preferred to target endogenous (regulatory) control elements, such as involved in translation, stability, or where applicable (enhancers and silencers) in addition to a promoter or promoter-proximal elements. Thus, the invention can also be used to target endogenous control elements (including enhancers and silencers) in addition to targeting of the promoter. These control elements can be located upstream and downstream of the transcriptional start site (TSS), starting from 200 bp from the TSS to 100 kb away. Targeting of known control elements can be used to activate or repress the gene of interest. In some cases, a single control element can influence the transcription of multiple target genes. Targeting of a single control element could therefore be used to control the transcription of multiple genes simultaneously.

Targeting of putative control elements on the other hand (e.g. by tiling the region of the putative control element as well as 200 bp up to 100 kB around the element) can be used as a means to verify such elements (by measuring the transcription of the gene of interest) or to detect novel control elements (e.g. by tiling 100 kb upstream and downstream of the TSS of the gene of interest). In addition, targeting of putative control elements can be useful in the context of understanding genetic causes of disease. Many mutations and common SNP variants associated with disease phenotypes are located outside coding regions. Targeting of such regions with either the activation or repression systems described herein can be followed by readout of transcription of either a) a set of putative targets (e.g. a set of genes located in closest proximity to the control element) or b) whole-transcriptome readout by e.g. RNAseq or microarray. This would allow for the identification of likely candidate genes involved in the disease phenotype. Such candidate genes could be useful as novel drug targets.

Histone acetyltransferase (HAT) inhibitors are mentioned herein. However, an alternative in some embodiments is for the one or more functional domains to comprise an acetyltransferase, preferably a histone acetyltransferase. These are useful in the field of epigenomics, for example in methods of interrogating the epigenome. Methods of interrogating the epigenome may include, for example, targeting epigenomic sequences. Targeting epigenomic sequences may include the guide being directed to an epigenomic target sequence. Epigenomic target sequence may include, in some embodiments, include a promoter, silencer or an enhancer sequence.

Use of a functional domain linked to a C2c2 effector protein as described herein, preferably a dead-C2c2 effector protein, more preferably a dead-FnC2c2 effector protein, to target epigenomic sequences can be used to activate or repress promoters, silencer or enhancers.

Examples of acetyltransferases are known but may include, in some embodiments, histone acetyltransferases. In some embodiments, the histone acetyltransferase may comprise the catalytic core of the human acetyltransferase p300 (Gerbasch & Reddy, Nature Biotech 6 Apr. 2015).

In some preferred embodiments, the functional domain is linked to a dead-C2c2 effector protein to target and activate epigenomic sequences such as promoters or enhancers. One or more guides directed to such promoters or enhancers may also be provided to direct the binding of the CRISPR enzyme to such promoters or enhancers.

In certain embodiments, the RNA targeting effector protein of the invention can be used to interfere with co-transcriptional modifications of DNA/chromatin structure, RNA-directed DNA methylation, or RNA-directed silencing/activation of DNA/chromatin. RNA-directed DNA methylation (RdDM) is an epigenetic process first discovered in plants. During RdDM, double-stranded RNAs (dsRNAs) are processed to 21-24 nucleotide small interfering RNAs (siRNAs) and guide methylation of homologous DNA loci. Besides RNA molecules, a plethora of proteins are involved in the establishment of RdDM, like Argonautes, DNA methyltransferases, chromatin remodelling complexes and the plant-specific PolIV and PoV. All these act in concert to add a methyl-group at the 5' position of cytosines. Small RNAs can modify the chromatin structure and silence transcription by guiding Argonaute-containing complexes to complementary nascent (non-coding) RNA trancripts. Subsequently the recruitment of chromatin-modifying complexes, including histone and DNA methyltransferases, is mediated. The RNA targeting effector protein of the invention may be used to target such small RNAs and interfere in interactions between these small RNAs and the nascent non-coding transcripts.

The term "associated with" is used here in relation to the association of the functional domain to the C2c2 effector protein or the adaptor protein. It is used in respect of how one molecule 'associates' with respect to another, for example between an adaptor protein and a functional domain, or between the C2c2 effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the C2c2 effector protein or adaptor protein is associated with a functional domain by binding thereto. In other embodiments, the C2c2 effector protein or adaptor protein is associated with a functional domain because the two are fused together, optionally via an intermediate linker.

Saturating Mutagenesis

The C2c2 effector protein system(s) described herein can be used to perform saturating or deep scanning mutagenesis of genomic loci in conjunction with a cellular phenotype—for instance, for determining critical minimal features and discrete vulnerabilities of functional elements required for gene expression, drug resistance, and reversal of disease. By saturating or deep scanning mutagenesis is meant that every or essentially every DNA base is cut within the genomic loci. A library of C2c2 effector protein guide RNAs may be introduced into a population of cells. The library may be introduced, such that each cell receives a single guide RNA (sgRNA). In the case where the library is introduced by transduction of a viral vector, as described herein, a low multiplicity of infection (MOI) is used. The library may include sgRNAs targeting every sequence upstream of a (protospacer adjacent motif) (PAM) sequence in a genomic locus. The library may include at least 100 non-overlapping genomic sequences upstream of a PAM sequence for every 1000 base pairs within the genomic locus. The library may include sgRNAs targeting sequences upstream of at least one different PAM sequence. The C2c2 effector protein systems may include more than one C2c2 protein. Any C2c2 effector protein as described herein, including orthologues or engineered C2c2 effector proteins that recognize different PAM sequences may be used. The frequency of off target sites for a sgRNA may be less than 500. Off target scores may be generated to select sgRNAs with the lowest off target sites. Any phenotype determined to be associated with cutting at a sgRNA target site may be confirmed by using sgRNAs targeting the same site in a single experiment. Validation of a target site may also be performed by using a modified C2c2 effector protein, as described herein, and two sgRNAs targeting the genomic site of interest. Not being bound by a theory, a target site is a true hit if the change in phenotype is observed in validation experiments.

With respect to the DNA-targeting proteins disclosed herein, the genomic loci may include at least one continuous genomic region. The at least one continuous genomic region may comprise up to the entire genome. The at least one continuous genomic region may comprise a functional element of the genome. The functional element may be within a non-coding region, coding gene, intronic region, promoter, or enhancer. The at least one continuous genomic region may comprise at least 1 kb, preferably at least 50 kb of genomic DNA. The at least one continuous genomic region may comprise a transcription factor binding site. The at least one continuous genomic region may comprise a region of DNase I hypersensitivity. The at least one continuous genomic region may comprise a transcription enhancer or repressor element. The at least one continuous genomic region may comprise a site enriched for an epigenetic signature. The at least one continuous genomic DNA region may comprise an epigenetic insulator. The at least one continuous genomic region may comprise two or more continuous genomic regions that physically interact. Genomic regions that interact may be determined by '4C technology'. 4C technology allows the screening of the entire genome in an unbiased manner for DNA segments that physically interact with a DNA fragment of choice, as is described in Zhao et al. ((2006) Nat Genet 38, 1341-7) and in U.S. Pat. No. 8,642,295, both incorporated herein by reference in its entirety. The epigenetic signature may be histone acetylation, histone methylation, histone ubiquitination, histone phosphorylation, DNA methylation, or a lack thereof.

The C2c2 effector protein system(s) for saturating or deep scanning mutagenesis can be used in a population of cells. The C2c2 effector protein system(s) can be used in eukaryotic cells, including but not limited to mammalian and plant cells. The population of cells may be prokaryotic cells. The population of eukaryotic cells may be a population of embryonic stem (ES) cells, neuronal cells, epithelial cells, immune cells, endocrine cells, muscle cells, erythrocytes, lymphocytes, plant cells, or yeast cells.

In one aspect, the present invention provides for a method of screening for functional elements associated with a change in a phenotype. The library may be introduced into a population of cells that are adapted to contain a C2c2 effector protein. The cells may be sorted into at least two groups based on the phenotype. The phenotype may be expression of a gene, cell growth, or cell viability. The relative representation of the guide RNAs present in each group are determined, whereby genomic sites associated with the change in phenotype are determined by the representation of guide RNAs present in each group. The change in phenotype may be a change in expression of a gene of interest. The gene of interest may be upregulated, downregulated, or knocked out. The cells may be sorted into a high expression group and a low expression group. The population of cells may include a reporter construct that is used to determine the phenotype. The reporter construct may include a detectable marker. Cells may be sorted by use of the detectable marker.

In another aspect, the present invention provides for a method of screening for genomic sites associated with resistance to a chemical compound. The chemical compound may be a drug or pesticide. The library may be introduced into a population of cells that are adapted to contain a C2c2 effector protein, wherein each cell of the population contains no more than one guide RNA; the population of cells are treated with the chemical compound; and the representation of guide RNAs are determined after treatment with the chemical compound at a later time point as compared to an early time point, whereby genomic sites associated with resistance to the chemical compound are determined by enrichment of guide RNAs. Representation of sgRNAs may be determined by deep sequencing methods.

Useful in the practice of the instant invention utilizing C2c2 effector protein complexes are methods used in CRISPR-Cas9 systems and reference is made to the article entitled BCL11A enhancer dissection by Cas9-mediated in situ saturating mutagenesis. Canver, M. C., Smith, E. C., Sher, F., Pinello, L., Sanjana, N. E., Shalem, O., Chen, D. D., Schupp, P. G., Vinjamur, D. S., Garcia, S. P., Luc, S., Kurita, R., Nakamura, Y., Fujiwara, Y., Maeda, T., Yuan, G., Zhang, F., Orkin, S. H., & Bauer, D. E. DOI:10.1038/nature15521, published online Sep. 16, 2015, the article is herein incorporated by reference and discussed briefly below:

Canver et al. involves novel pooled CRISPR-Cas9 guide RNA libraries to perform in situ saturating mutagenesis of the human and mouse BCL1A erythroid enhancers previously identified as an enhancer associated with fetal hemoglobin (HbF) level and whose mouse ortholog is necessary for erythroid BCL11A expression. This approach revealed critical minimal features and discrete vulnerabilities of these enhancers. Through editing of primary human progenitors and mouse transgenesis, the authors validated the BCL11A erythroid enhancer as a target for HbF reinduction. The authors generated a detailed enhancer map that informs therapeutic genome editing.

Method of Using C2c2 Systems to Modify a Cell or Organism

The invention in some embodiments comprehends a method of modifying a cell or organism. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced.

The system may comprise one or more different vectors. In an aspect of the invention, the effector protein is codon optimized for expression the desired cell type, preferentially a eukaryotic cell, preferably a mammalian cell or a human cell.

Packaging cells are typically used to form virus particles that are capable of infecting a host cell. Such cells include 293 cells, which package adenovirus, and ψ2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, CIR, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-OT1/2, C6/36, Cal-27, CHO, CHO-7, CHO-IR, CHO-K1, CHO-K2, CHO-T, CHO Dhfr -/-, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepalc1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK I, MOR/0.2R, MONO-MAC 6, MTD-A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a nucleic acid-targeting system as described herein (such as by transient transfection of one or more vectors, or transfection with RNA), and modified through the activity of a nucleic acid-targeting complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, one or more vectors described herein are used to produce a non-human transgenic animal or transgenic plant. In some embodiments, the transgenic animal is a mammal, such as a mouse, rat, or rabbit. In certain embodiments, the organism or subject is a plant. In certain embodiments, the organism or subject or plant is algae. Methods for producing transgenic plants and animals are known in the art, and generally begin with a method of cell transfection, such as described herein.

In one aspect, the invention provides for methods of modifying a target polynucleotide in a eukaryotic cell. In some embodiments, the method comprises allowing a nucleic acid-targeting complex to bind to the target polynucleotide to effect cleavage of said target polynucleotide thereby modifying the target polynucleotide, wherein the nucleic acid-targeting complex comprises a nucleic acid-targeting effector protein complexed with a guide RNA hybridized to a target sequence within said target polynucleotide.

In one aspect, the invention provides a method of modifying expression of a polynucleotide in a eukaryotic cell. In some embodiments, the method comprises allowing a nucleic acid-targeting complex to bind to the polynucleotide such that said binding results in increased or decreased expression of said polynucleotide; wherein the nucleic acid-targeting complex comprises a nucleic acid-targeting effector protein complexed with a guide RNA hybridized to a target sequence within said polynucleotide.

C2c2 Effector Protein Complexes can be Used in Plants

The C2c2 effector protein system(s) (e.g., single or multiplexed) can be used in conjunction with recent advances in crop genomics. The systems described herein can be used to perform efficient and cost-effective plant gene or genome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. The C2c2 effector protein system(s) can be used with regard to plants in Site-Directed Integration (SDI) or Gene Editing (GE) or any Near Reverse Breeding (NRB) or Reverse Breeding (RB) techniques. Aspects of utilizing the herein described C2c2 effector protein systems may be analogous to the use of the CRISPR-Cas (e.g. CRISPR-Cas9) system in plants, and mention is made of the University of Arizona website "CRISPR-PLANT" (arizona.edu/crispr) (supported by Penn State and AGI). Embodiments of the invention can be used in genome editing in plants or where RNAi or similar genome editing techniques have been used previously; see, e.g., Nekrasov, "Plant genome editing made easy: targeted mutagenesis in model and crop plants using the CRISPR-Cas system," Plant Methods 2013, 9:39 (doi:10.1186/1746-4811-9-39); Brooks, "Efficient gene editing in tomato in the first generation using the CRISPR-Cas9 system," Plant Physiology September 2014 pp 114.247577; Shan, "Targeted genome modification of crop plants using a CRISPR-Cas system," Nature Biotechnology 31, 686-688 (2013); Feng, "Efficient genome editing in plants using a CRISPR/Cas system," Cell Research (2013) 23:1229-1232. doi:10.1038/cr.2013.114; published online 20 Aug. 2013; Xie, "RNA-guided genome editing in plants using a CRISPR-Cas system," Mol Plant. 2013 November; 6(6):1975-83. doi: 10.1093/mp/sst119. Epub 2013 Aug. 17; Xu, "Gene targeting using the *Agrobacterium tumefaciens*-mediated CRISPR-Cas system in rice," Rice 2014, 7:5 (2014), Zhou et al., "Exploiting SNPs for biallelic CRISPR mutations in the outcrossing woody perennial *Populus* reveals 4-coumarate: CoA ligase specificity and Redundancy," New Phytologist (2015) (Forum) 1-4 (available online only at newphytologist.com); Caliando et al, "Targeted DNA degradation using a CRISPR device stably carried in the host genome, NATURE COMMUNICATIONS 6:6989, DOI: 10.1038/ncomms7989, U.S. Pat. No. 6,603,061—*Agrobacterium*-Mediated Plant Transformation Method; U.S. Pat. No. 7,868,149—Plant Genome Sequences and Uses Thereof and US 2009/0100536—Transgenic Plants with Enhanced Agronomic Traits, all the contents and disclosure of each of which are herein incorporated by reference in their entirety. In the practice of the invention, the contents and disclosure of Morrell et al "Crop genomics: advances and applications," Nat Rev Genet. 2011 Dec. 29; 13(2):85-96; each of which is incorporated by reference herein including as to how herein embodiments may be used as to plants. Accordingly, reference herein to animal cells may also apply, mutatis mutandis, to plant cells unless otherwise apparent; and, the enzymes herein having reduced off-target effects and systems employing such enzymes can be used in plant applications, including those mentioned herein.

Sugano et al. (Plant Cell Physiol. 2014 March; 55(3):475-81. doi: 10.1093/pcp/pcu014. Epub 2014 Jan. 18) reports the application of CRISPR-Cas9 to targeted mutagenesis in the liverwort *Marchantia polymorpha* L., which has emerged as a model species for studying land plant evolution. The U6 promoter of *M. polymorpha* was identified and cloned to express the gRNA. The target sequence of the gRNA was designed to disrupt the gene encoding auxin response factor 1 (ARF1) in *M. polymorpha*. Using *Agrobacterium*-mediated transformation, Sugano et al. isolated stable mutants in the gametophyte generation of *M. polymorpha*. CRISPR-Cas9-based site-directed mutagenesis in vivo was achieved using either the Cauliflower mosaic virus 35S or *M. polymorpha* EF1α promoter to express Cas9. Isolated mutant individuals showing an auxin-resistant phenotype were not chimeric. Moreover, stable mutants were produced by asexual reproduction of T1 plants. Multiple arf1 alleles were easily established using CRIPSR/Cas9-based targeted mutagenesis. The C2c2 systems of the present invention can be used to regulate the same as well as other genes, and like expression control systems such as RNAi and siRNA, the method of the invention can be inducible and reversible.

Kabadi et al. (Nucleic Acids Res. 2014 Oct. 29; 42(19): e147. doi: 10.1093/nar/gku749. Epub 2014 Aug. 13) developed a single lentiviral system to express a Cas9 variant, a reporter gene and up to four sgRNAs from independent RNA polymerase III promoters that are incorporated into the vector by a convenient Golden Gate cloning method. Each sgRNA was efficiently expressed and can mediate multiplex gene editing and sustained transcriptional activation in immortalized and primary human cells. The instant invention can be used to regulate the plant genes of Kabadi.

Xing et al. (BMC Plant Biology 2014, 14:327) developed a CRISPR-Cas9 binary vector set based on the pGreen or pCAMBIA backbone, as well as a gRNA. This toolkit requires no restriction enzymes besides BsaI to generate final constructs harboring maize-codon optimized Cas9 and one or more gRNAs with high efficiency in as little as one cloning step. The toolkit was validated using maize protoplasts, transgenic maize lines, and transgenic *Arabidopsis* lines and was shown to exhibit high efficiency and specificity. More importantly, using this toolkit, targeted mutations of three *Arabidopsis* genes were detected in transgenic seedlings of the T1 generation. Moreover, the multiple-gene mutations could be inherited by the next generation. (guide RNA)module vector set, as a toolkit for multiplex genome editing in plants. The C2c2 systems and proteins of the instant invention may be used to target the genes targeted by Xing.

The C2c2 CRISPR systems of the invention may be used in the detection of plant viruses. Gambino et al. (Phytopathology. 2006 November; 96(11):1223-9. doi: 10.1094/PHYTO-96-1223) relied on amplification and multiplex PCR for simultaneous detection of nine grapevine viruses. The C2c2 systems and proteins of the instant invention may similarly be used to detect multiple targets in a host. Moreover, the systems of the invention can be used to simultaneously knock down viral gene expression in valuable cultivars, and prevent activation or further infection by targeting expressed vial RNA.

Murray et al. (Proc Biol Sci. 2013 Jun. 26; 280(1765): 20130965. doi: 10.1098/rspb.2013.0965; published 2013 Aug. 22) analyzxed 12 plant RNA viruses to investigatge evoluationary rates and found evidence of episodic selection possibly due to shifts between different host genotyopes or species. The C2c2 systems and proteins of the instant invention may be used to tarteg or immunize against such viruses in a host. For example, the systems of the invention can be used to block viral RNA expression hence replication. Also, the invention can be used to target nuclic acids for cleavage as wll as to target expression or activation. Moreover, the systems of the invention can be multiplexed so as to hit multiple targets or multiple isolate of the same virus.

Ma et al. (Mol Plant. 2015 Aug. 3; 8(8):1274-84. doi: 10.1016/j.molp.2015.04.007) reports robust CRISPR-Cas9 vector system, utilizing a plant codon optimized Cas9 gene, for convenient and high-efficiency multiplex genome editing in monocot and dicot plants. Ma et al. designed PCR-based procedures to rapidly generate multiple sgRNA expression cassettes, which can be assembled into the binary CRISPR-Cas9 vectors in one round of cloning by Golden Gate ligation or Gibson Assembly. With this system, Ma et al. edited 46 target sites in rice with an average 85.4% rate of mutation, mostly in biallelic and homozygous status. Ma et al. provide examples of loss-of-function gene mutations in TO rice and TArabidopsis plants by simultaneous targeting of multiple (up to eight) members of a gene family, multiple genes in a biosynthetic pathway, or multiple sites in a single gene. Similarly, the C2c2 systems of the instant invention can dffieicnelty target expression of multiple genes simultaneously.

Lowder et al. (Plant Physiol. 2015 Aug. 21. pii: pp. 00636.2015) also developed a CRISPR-Cas9 toolbox enables multiplex genome editing and transcriptional regulation of expressed, silenced or non-coding genes in plants. This toolbox provides researchers with a protocol and reagents to quickly and efficiently assemble functional CRISPR-Cas9 T-DNA constructs for monocots and dicots using Golden Gate and Gateway cloning methods. It comes with a full suite of capabilities, including multiplexed gene editing and transcriptional activation or repression of plant endogenous genes. T-DNA based transformation technology is fundamental to modern plant biotechnology, genetics, molecular biology and physiology. As such, we developed a method for the assembly of Cas9 (WT, nickase or dCas9) and gRNA(s) into a T-DNA destination-vector of interest. The assembly method is based on both Golden Gate assembly and MultiSite Gateway recombination. Three modules are required for assembly. The first module is a Cas9 entry vector, which contains promoterless Cas9 or its derivative genes flanked by attL1 and attR5 sites. The second module is a gRNA entry vector which contains entry gRNA expression cassettes flanked by attL5 and attL2 sites. The third module includes attR1-attR2-containing destination T-DNA vectors that provide promoters of choice for Cas9 expression. The toolbox of Lowder et al. may be applied to the C2c2 effector protein system of the present invention.

Organisms such as yeast and microalgae are widely used for synthetic biology. Stovicek et al. (Metab. Eng. Comm., 2015; 2:13 describes genome editing of industrial yeast, for example, *Saccharomyces cerevisae*, to efficiently produce robust strains for industrial production. Stovicek used a CRISPR-Cas9 system codon-optimized for yeast to simultaneously disrupt both alleles of an endogenous gene and knock in a heterologous gene. Cas9 and gRNA were expressed from genomic or episomal 2μ-based vector locations. The authors also showed that gene disruption efficiency could be improved by optimization of the levels of Cas9 and gRNA expression. Hlavová et al. (Biotechnol. Adv. 2015) discusses development of species or strains of microalgae using techniques such as CRISPR to target nuclear and chloroplast genes for insertional mutagenesis and screening. The same plasmids and vectors can be applied to the C2c2 systems of the instant invention.

Petersen ("Towards precisely glycol engineered plants," Plant Biotech Denmark Annual meeting 2015, Copenhagen, Denmark) developed a method of using CRISPR/Cas9 to engineer genome changes in *Arabidopsis*, for example to glyco engineer *Arabidopsis* for production of proteins and products having desired posttranslational modifications. Hebelstrup et al. (Front Plant Sci. 2015 Apr. 23; 6:247) outlines in planta starch bioengineering, providing crops that express starch modifying enzymes and directly produce products that normally are made by industrial chemical and/or physical treatments of starches. The methods of Petersen and Hebelstrup may be applied to the C2c2 effector protein system of the present invention.

Kurthe t al, J Virol. 2012 June; 86(11):6002-9. doi: 10.1128/JVI.00436-12. Epub 2012 Mar. 21) developed an RNA virus-based vector for the introduction of desired traits into grapevine without heritable modifications to the genome. The vector provided the ability to regulate expression of of endogenous genes by virus-induced gene silencing. The C2c2 systems and proteins of the instant invention can be used to silence genes and proteins without heritable modification to the genome.

In an embodiment, the plant may be a legume. The present invention may utilize the herein disclosed CRISP-Cas system for exploring and modifying, for example, without limitation, soybeans, peas, and peanuts. Curtin et al. provides a toolbox for legume function genomics. (See Curtin et al., "A genome engineering toolbox for legume Functional genomics," International Plant and Animal Genome Conference XXII 2014). Curtin used the genetic transformation of CRISPR to knock-out/down single copy and duplicated legume genes both in hairy root and whole plant systems. Some of the target genes were chosen in order to explore and optimize the features of knock-out/down systems (e.g., phytoene desaturase), while others were identified by soybean homology to *Arabidopsis* Dicer-like genes or by genome-wide association studies of nodulation in *Medicago*. The C2c2 systems and proteins of the instant invention can be used to knockout/knockdown systems.

Peanut allergies and allergies to legumes generally are a real and serious health concern. The C2c2 effector protein system of the present invention can be used to identify and then edit or silence genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11(3):222).

In an advantageous embodiment, the plant may be a tree. The present invention may also utilize the herein disclosed CRISPR Cas system for herbaceous systems (see, e.g., Belhaj et al., Plant Methods 9: 39 and Harrison et al., Genes & Development 28: 1859-1872). In a particularly advantageous embodiment, the CRISPR Cas system of the present invention may target single nucleotide polymorphisms (SNPs) in trees (see, e.g., Zhou et al., New Phytologist, Volume 208, Issue 2, pages 298-301, October 2015). In the Zhou et al. study, the authors applied a CRISPR Cas system in the woody perennial *Populus* using the 4-coumarate:CoA ligase (4CL) gene family as a case study and achieved 100% mutational efficiency for two 4CL genes targeted, with every transformant examined carrying biallelic modifications. In the Zhou et al., study, the CRISPR-Cas9 system was highly sensitive to single nucleotide polymorphisms (SNPs), as cleavage for a third 4CL gene was abolished due to SNPs in the target sequence. These methods may be applied to the C2c2 effector protein system of the present invention.

The methods of Zhou et al. (New Phytologist, Volume 208, Issue 2, pages 298-301, October 2015) may be applied to the present invention as follows. Two 4CL genes, 4CL1 and 4CL2, associated with lignin and flavonoid biosynthesis, respectively are targeted for CRISPR-Cas9 editing. The *Populus tremula*×alba clone 717-1B4 routinely used for transformation is divergent from the genome-sequenced *Populus trichocarpa*. Therefore, the 4CL1 and 4CL2 gRNAs designed from the reference genome are interrogated with in-house 717 RNA-Seq data to ensure the absence of SNPs which could limit Cas efficiency. A third gRNA designed for 4CL5, a genome duplicate of 4CL1, is also included. The corresponding 717 sequence harbors one SNP in each allele near/within the PAM, both of which are expected to abolish targeting by the 4CL5-gRNA. All three gRNA target sites are located within the first exon. For 717 transformation, the gRNA is expressed from the *Medicago* U6.6 promoter, along with a human codon-optimized Cas under control of the CaMV 35S promoter in a binary vector. Transformation with the Cas-only vector can serve as a control. Randomly selected 4CL1 and 4CL2 lines are subjected to amplicon-sequencing. The data is then processed and biallelic mutations are confirmed in all cases. These methods may be applied to the C2c2 effector protein system of the present invention.

In plants, pathogens are often host-specific. For example, *Fusarium oxysporum* f. sp. *lycopersici* causes tomato wilt but attacks only tomato, and *F. oxysporum* f. *dianthii Puccinia graminis* f. sp. *tritici* attacks only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible. There can also be Horizontal Resistance, e.g., partial resistance against all races of a pathogen, typically controlled by many genes and Vertical Resistance, e.g., complete resistance to some races of a pathogen but not to other races, typically controlled by a few genes. In a Gene-for-Gene level, plants and pathogens evolve together, and the genetic changes in one balance changes in other. Accordingly, using Natural Variability, breeders combine most useful genes for Yield, Quality, Uniformity, Hardiness, Resistance. The sources of resistance genes include native or foreign Varieties, Heirloom Varieties, Wild Plant Relatives, and Induced Mutations, e.g., treating plant material with mutagenic agents. Using the present invention, plant breeders are provided with a new tool to induce mutations. Accordingly, one skilled in the art can analyze the genome of sources of resistance genes, and in Varieties having desired characteristics or traits employ the present invention to induce the rise of resistance genes, with more precision than previous mutagenic agents and hence accelerate and improve plant breeding programs.

Aside from the plants otherwise discussed herein and above, engineered plants modified by the effector protein and suitable guide, and progeny thereof, as provided. These may include disease or drought resistant crops, such as wheat, barley, rice, soybean or corn; plants modified to remove or reduce the ability to self-pollinate (but which can instead, optionally, hybridise instead); and allergenic foods such as peanuts and nuts where the immunogenic proteins have been disabled, destroyed or disrupted by targeting via a effector protein and suitable guide.

Therapeutic Treatment

The system of the invention can be applied in areas of former RNA cutting technologies, without undue experimentation, from this disclosure, including therapeutic, assay and other applications, because the present application provides the foundation for informed engineering of the system. The present invention provides for therapeutic treatment of a disease caused by overexpression of RNA, toxic RNA and/or mutated RNA (such as, for example, splicing defects or truncations). Expression of the toxic RNA may be associated with formation of nuclear inclusions and late-onset degenerative changes in brain, heart or skeletal muscle. In the best studied example, myotonic dystrophy, it appears that the main pathogenic effect of the toxic RNA is to sequester binding proteins and compromise the regulation of alternative splicing (Hum. Mol. Genet. (2006) 15 (suppl 2): R162-R169). Myotonic dystrophy [dystrophia myotonica (DM)] is of particular interest to geneticists because it produces an extremely wide range of clinical features. A partial listing would include muscle wasting, cataracts, insulin resistance, testicular atrophy, slowing of cardiac conduction, cutaneous tumors and effects on cognition. The classical form of DM, which is now called DM type 1 (DM1), is caused by an expansion of CTG repeats in the 3'-untranslated region (UTR) of DMPK, a gene encoding a cytosolic protein kinase.

The below table presents a list of exons shown to have misregulated alternative splicing in DM1 skeletal muscle, heart or brain.

TABLE 8

| Tissue/gene Target | | Reference |
|---|---|---|
| Skeletal muscle | | |
| ALP | ex 5a, 5b | Lin X., et al. Failure of MBNL1-dependent postnatal splicing transitions in myotonic dystrophy. Hum. Mol. Genet 2006; 15: 2087-2097 |
| CAPN3 | ex 16 | Lin X., et al. Failure of MBNL1-dependent postnatal splicing transitions in myotonic dystrophy. Hum. Mol. Genet 2006; 15: 2087-2097 |
| CLCN1 | int 2, ex 7a, 8a | Mankodi A., et al. Expanded CUG repeats trigger aberrant splicing of ClC-1 chloride channel pre-mRNA and hyperexcitability of skeletal muscle in myotonic dystrophy. Mol. Cell 2002; 10: 35-44 Charlet-B N., et al. Loss of the muscle-specific chloride channel in type 1 myotonic dystrophy due to misregulated alternative splicing. Mol. Cell 2002; 10: 45-53 |
| FHOS | ex 11a | Lin X., et al. Failure of MBNL1-dependent postnatal splicing transitions in myotonic dystrophy. Hum. Mol. Genet 2006; 15: 2087-2097 |
| GFAT1 | ex 10 | Lin X., et al. Failure of MBNL1-dependent postnatal splicing transitions in myotonic dystrophy. Hum. Mol. Genet 2006; 15: 2087-2097 |
| IR | ex 11 | Savkur R.S., et al. Aberrant regulation of insulin receptor alternative splicing is associated with insulin resistance in myotonic dystrophy. Nat. Genet. 2001; 29: 40-47 |

TABLE 8-continued

| Tissue/gene Target | | Reference |
|---|---|---|
| MBNL1 | ex 7 | Lin X., et al. Failure of MBNL1-dependent postnatal splicing transitions in myotonic dystrophy. Hum. Mol. Genet 2006; 15: 2087-2097 |
| MBNL2 | ex 7 | Lin X., et al. Failure of MBNL1-dependent postnatal splicing transitions in myotonic dystrophy. Hum. Mol. Genet 2006; 15: 2087-2097 |
| MTMR1 | ex 2.1, 2.2 | Buj-Bello A., et al. Muscle-specific alternative splicing of myotubularin-related 1 gene is impaired in DM1 muscle cells. Hum. Mol. Genet. 2002; 11: 2297-2307 |
| NRAP | ex 12 | Lin X., et al. Failure of MBNL1-dependent postnatal splicing transitions in myotonic dystrophy. Hum. Mol. Genet 2006; 15: 2087-2097 |
| RYR1 | ex 70 | Kimura T., et al. Altered mRNA splicing of the skeletal muscle ryanodine receptor and sarcoplasmic/endoplasmic reticulum Ca2+-ATPase in myotonic dystrophy type 1. Hum. Mol. Genet. 2005; 14: 2189-2200 |
| SERCA1 | ex 22 | Kimura T., et al. Altered mRNA splicing of the skeletal muscle ryanodine receptor and sarcoplasmic/endoplasmic reticulum Ca2+-ATPase in myotonic dystrophy type 1. Hum. Mol. Genet. 2005; 14: 2189-2200<br>Lin X., et al. Failure of MBNL1-dependent postnatal splicing transitions in myotonic dystrophy. Hum. Mol. Genet 2006; 15: 2087-2097 |
| z-Titin | ex Zr4, Zr5 | Lin X., et al. Failure of MBNL1-dependent postnatal splicing transitions in myotonic dystrophy. Hum. Mol. Genet 2006; 15: 2087-2097 |
| m-Titin | M-line ex5 | Lin X., et al. Failure of MBNL1-dependent postnatal splicing transitions in myotonic dystrophy. Hum. Mol. Genet 2006; 15: 2087-2097 |
| TNNT3 | fetal ex | Kanadia R.N., et al. A muscleblind knockout model for myotonic dystrophy. Science 2003; 302: 1978-1980 |
| ZASP | ex 11 | Lin X., et al. Failure of MBNL1-dependent postnatal splicing transitions in myotonic dystrophy. Hum. Mol. Genet 2006; 15: 2087-2097 |
| | Heart | |
| TNNT2 | ex 5 | Philips A.V., et al. Disruption of splicing regulated by a CUG-binding protein in myotonic dystrophy. Science 1998; 280: 737-741 |
| ZASP | ex 11 | Mankodi A., et al. Nuclear RNA foci in the heart in myotonic dystrophy. Circ. Res. 2005; 97: 1152-1155 |
| m-Titin | M-line ex 5 | Mankodi A., et al. Nuclear RNA foci in the heart in myotonic dystrophy. Circ. Res. 2005; 97: 1152-1155 |
| KCNAB1 | ex 2 | Mankodi A., et al. Nuclear RNA foci in the heart in myotonic dystrophy. Circ. Res. 2005; 97: 1152-1155 |
| ALP | ex 5 | (Mankodi A., et al. Nuclear RNA foci in the heart in myotonic dystrophy. Circ. Res. 2005; 97: 1152-1155 |
| | Brain | |
| TAU | ex 2, ex 10 | Sergeant N., et al. Dysregulation of human brain microtubule-associated tau mRNA maturation in myotonic dystrophy type 1. Hum. Mol. Genet. 2001; 10: 2143-2155<br>Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |
| APP | ex 7 | Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |
| NMDAR1 | ex 5 | Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |

The enzymes of the present invention may target overexpressed RNA or toxic RNA, such as for example, the DMPK gene or any of the misregulated alternative splicing in DM1 skeletal muscle, heart or brain in, for example, the above table.

The enzymes of the present invention may also target trans-acting mutations affecting RNA-dependent functions that cause disease (summarized in Cell. 2009 Feb. 20; 136(4): 777-793) as indicated in the below table.

TABLE 9

| DISEASE | GENE/MUTATION | FUNCTION |
|---|---|---|
| Prader Willi syndrome | SNORD116 | ribosome biogenesis |
| Spinal muscular atrophy (SMA) | SMN2 | splicing |

TABLE 9-continued

| DISEASE | GENE/MUTATION | FUNCTION |
| --- | --- | --- |
| Dyskeratosis congenita (X-linked) | DKC1 | telomerase/translation |
| Dyskeratosis congenita (autosomal dominant) | TERC | telomerase |
| Dyskeratosis congenita (autosomal dominant) | TERT | telomerase |
| Diamond-Blackfan anemia | RPS19, RPS24 | ribosome biogenesis |
| Shwachman-Diamond syndrome | SBDS | ribosome biogenesis |
| Treacher-Collins syndrome | TCOF1 | ribosome biogenesis |
| Prostate cancer | SNHG5 | ribosome biogenesis |
| Myotonic dystrophy, type 1 (DM1) | DMPK (RNA gain-of-function) | protein kinase |
| Myotonic dystrophy type 2 (DM2) | ZNF9 (RNA gain-of-function) | RNA binding |
| Spinocerebellar ataxia 8 (SCA8) | ATXN8/ATXN8OS (RNA gain-of-function) | unknown/noncoding RNA |
| Huntington's disease-like 2 (HDL2) | JPH3 (RNA gain-of-function) | ion channel function |
| Fragile X-associated tremor ataxia syndrome (FXTAS) | FMR1 (RNA gain-of-function) | translation/mRNA localization |
| Fragile X syndrome | FMR1 | translation/mRNA localization |
| X-linked mental retardation | UPF3B | translation/nonsense mediated decay |
| Oculopharyngeal muscular dystrophy (OPMD) | PABPN1 | 3' end formation |
| Human pigmentary genodermatosis | DSRAD | editing |
| Retinitis pigmentosa | PRPF31 | splicing |
| Retinitis pigmentosa | PRPF8 | splicing |
| Retinitis pigmentosa | HPRP3 | splicing |
| Retinitis pigmentosa | PAP1 | splicing |
| Cartilage-hair hypoplasia(recessive) | RMRP | splicing |
| Autism | 7q22-q33 locus breakpoint | noncoding RNA |
| Beckwith-Wiedemann syndrome (BWS) | H19 | noncoding RNA |
| Charcot-Marie-Tooth (CMT) Disease | GRS | translation |
| Charcot-Marie-Tooth (CMT) Disease | YRS | translation |
| Amyotrophic lateral sclerosis (ALS) | TARDBP | splicing, transcription |
| Leukoencephalopathy with vanishing white matter | EIF2B1 | translation |
| Wolcott-Rallison syndrome | EIF2AK3 | translation (protease) |
| Mitochondrial myopathy and sideroblastic anemia (MLASA) | PUS1 | translation |
| Encephalomyopathy and hypertrophic cardiomyopathy | TSFM | translation (mitochondrial) |
| Hereditary spastic paraplegia | SPG7 | ribosome biogenesis |
| Leukoencephalopathy | DARS2 | translation (mitochondrial) |
| Susceptibility to diabetes mellitus | LARS2 | translation (mitochondrial) |
| Deafness | MTRNR1 | ribosome biogenesis (mitochondrial) |
| MELAS syndrome, deafness | MTRNR2 | ribosome biogenesis (mitochondrial) |
| Cancer | SFRS1 | splicing, translation, export |
| Cancer | RBM5 | splicing |
| Multiple disorders | mitochondrial tRNA mutations | translation (mitochondrial) |
| Cancer | miR-17-92 cluster | RNA interference |
| Cancer | miR-372/miR-373 | RNA interference |

The enzyme of the present invention may also be used in the treatment of various tauopathies, including primary and secondary tauopathies, such as primary age-related tauopathy (PART)/Neurofibrillary tangle-predominant seniledementia, with NFTs similar to AD, but without plaques, dementia pugilistica (chronic traumatic encephalopathy), progressive supranuclear palsy, corticobasal degeneration, frontotemporal dementia and parkinsonism linked to chromosome 17, lytico-Bodig disease (Parkinson-dementia complex of Guam), ganglioglioma andgangliocytoma, meningioangiomatosis, postencephaliticparkinsonism, subacute sclerosing panencephalitis, as well as lead encephalopathy, tuberous sclerosis, Hallervorden-Spatzdisease, and lipofuscinosis, alzheimers disease. The enzymes of the present invention may also target mutationsdisruptingthcis-actingsplicingcodcausesplicingdefectsand disease (summarized in Cell. 2009 Feb. 20; 136(4): 777-793). The motor neuron degenerative disease SMA results from deletion of the SMN1 gene. The remaining SMN2 gene has a C→T substitution in exon 7 that inactivates an exonic splicing enhancer (ESE), and creates an exonic splicing silencer (ESS), leading to exon 7 skipping and a truncated protein (SMNA7). A T→A substitution in exon 31 of the dystrophin gene simultaneously creates a premature termination codon (STOP) and an ESS, leading to exon 31 skipping. This mutation causes a mild form of DMD because the mRNA lacking exon 31 produces a partially functional protein. Mutations within and downstream of exon 10 of the MAPT gene encoding the tau protein affect splicing regulatory elements and disrupt the normal 1:1 ratio of mRNAs including or excluding exon 10. This results in a perturbed balance between tau proteins containing either four or three microtubule-binding domains (4R-tau and 3R-tau, respectively), causing the neuropathological disorder FTDP-17. The example shown is the N279K mutation which enhances an ESE function promoting exon 10 inclusion and shifting the balance toward increased 4R-tau. Polymorphic (UG)m(U)n tracts within the 3' splice site of the CFTR gene exon 9 influence the extent of exon 9 inclusion and the level of full-length functional protein, modifying the severity of cystic fibrosis (CF) caused by a mutation elsewhere in the CFTR gene.

The innate immune system detects viral infection primarily by recognizing viral nucleic acids inside an infected cell, referred to as DNA or RNA sensing. In vitro RNA sensing assays can be used to detect specific RNA substrates. The RNA targeting effector protein can for instance be used for RNA-based sensing in living cells. Examples of applications are diagnostics by sensing of, for examples, disease-specific RNAs.

The RNA targeting effector protein of the invention can further be used for antiviral activity, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. provided is therefore the use of an RNA targeting effector protein of the invention as an antiviral agent.

Therapeutic dosages of the enzyme system of the present invention to target RNA the above-referenced RNAs are contemplated to be about 0.1 to about 2 mg/kg the dosages may be administered sequentially with a monitored response, and repeated dosages if necessary, up to about 7 to 10 doses per patient. Advantageously, samples are collected from each patient during the treatment regimen to ascertain the effectiveness of treatment. For example, RNA samples may be isolated and quantified to determine if expression is reduced or ameliorated. Such a diagnostic is within the purview of one of skill in the art.

With respect to general information on CRISPR-Cas Systems, mention is made of the following (also hereby incorporated herein by reference):

Multiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121):819-23 (2013);

RNA-guided editing of bacterial genomes using CRISPR-Cas systems. Jiang W., Bikard D., Cox D., Zhang F, Marraffini L A. Nat Biotechnol March; 31(3):233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463): 472-6. doi: 10.1038/Nature12466. Epub 2013 Aug. 23 (2013);

Double Nicking by RNA-Guided CRISPR Cas9 for Enhanced Genome Editing Specificity. Ran, F A., Hsu, P D., Lin, C Y., Gootenberg, J S., Konermann, S., Trevino, A E., Scott, D A., Inoue, A., Matoba, S., Zhang, Y., & Zhang, F. Cell August 28. pii: S0092-8674(13)01015-5 (2013-A);

DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013);

Genome engineering using the CRISPR-Cas9 system. Ran, F A., Hsu, P D., Wright, J., Agarwala, V., Scott, D A., Zhang, F. Nature Protocols November; 8(11):2281-308 (2013-B);

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013). [Epub ahead of print];

Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure™, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014 (2014);

Development and Applications of CRISPR-Cas9 for Genome Engineering, Hsu P D, Lander E S, Zhang F., Cell. June 5; 157(6):1262-78 (2014).

Genetic screens in human cells using the CRISPR/Cas9 system, Wang T, Wei J J, Sabatini D M, Lander E S., Science. January 3; 343(6166): 80-84. doi:10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1):102-6 (2015);

Genome-scale transcriptional activation by an engineered CRISPR-Cas9 complex, Konermann S, Brigham M D, Trevino A E, Joung J, Abudayyeh O O, Barcena C, Hsu P D, Habib N, Gootenberg J S, Nishimasu H, Nureki O, Zhang F., Nature. January 29; 517(7536):583-8 (2015).

A split-Cas9 architecture for inducible genome editing and transcription modulation, Zetsche B, Volz S E, Zhang F., (published online 2 Feb. 2015) Nat Biotechnol. February; 33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520(7546):186-91 (2015).

Shalem et al., "High-throughput functional genomics using CRISPR-Cas9," Nature Reviews Genetics 16, 299-311 (May 2015).

Xu et al., "Sequence determinants of improved CRISPR sgRNA design," Genome Research 25, 1147-1157 (August 2015).

Parnas et al., "A Genome-wide CRISPR Screen in Primary Immune Cells to Dissect Regulatory Networks," Cell 162, 675-686 (Jul. 30, 2015).

Ramanan et al., CRISPR/Cas9 cleavage of viral DNA efficiently suppresses hepatitis B virus," Scientific Reports 5:10833. doi: 10.1038/srep10833 (Jun. 2, 2015).

Nishimasu et al., Crystal Structure of *Staphylococcus aureus* Cas9," Cell 162, 1113-1126 (Aug. 27, 2015).

BCL11A enhancer dissection by Cas9-mediated in situ saturating mutagenesis, Canver et al., Nature 527(7577): 192-7 (Nov. 12, 2015) doi: 10.1038/nature15521. Epub 2015 Sep. 16.

*Cpf1 Is a Single RNA-Guided Endonuclease of a Class 2 CRISPR-Cas System*, Zetsche et al., Cell 163, 759-71 (Sep. 25, 2015).

*Discovery and Functional Characterization of Diverse Class 2 CRISPR-Cas Systems*, Shmakov et al., Molecular Cell, 60(3), 385-397 doi: 10.1016/j.molcel.2015.10.008 Epub Oct. 22, 2015.

*Rationally engineered Cas9 nucleases with improved specificity*, Slaymaker et al., Science 2016 Jan. 1, 351(6268): 84-88 doi: 10.1126/science.aad5227. Epub 2015 Dec. 1. [Epub ahead of print].

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli,* 65% that were recovered contained the mutation.

Wang et al. (2013) used the CRISPR/Cas system for the one-step generation of mice carrying mutations in multiple genes which were traditionally generated in multiple steps by sequential recombination in embryonic stem cells and/or time-consuming intercrossing of mice with a single mutation. The CRISPR/Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and sgRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays. Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity. End Edits Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Canver et al. (2015) demonstrated a CRISPR-Cas9-based functional investigation of non-coding genomic elements. The authors we developed pooled CRISPR-Cas9 guide RNA libraries to perform in situ saturating mutagenesis of the human and mouse BCL11A enhancers which revealed critical features of the enhancers.

Zetsche et al. (2015) reported characterization of Cpf1, a class 2 CRISPR nuclease from *Francisella novicida* U112 having features distinct from Cas9. Cpf1 is a single RNA-guided endonuclease lacking tracrRNA, utilizes a T-rich protospacer-adjacent motif, and cleaves DNA via a staggered DNA double-stranded break.

Shmakov et al. (2015) reported three distinct Class 2 CRISPR-Cas systems. Two system CRISPR enzymes (C2c1 and C2c3) contain RuvC-like endonuclease domains distantly related to Cpf1. Unlike Cpf1, C2c depends on both crRNA and tracrRNA for DNA cleavage. The third enzyme (C2c2) contains two predicted HEPN RNase domains and is tracrRNA independent.

Slaymaker et al (2016) reported the use of structure-guided protein engineering to improve the specificity of *Streptococcus pyogenes* Cas9 (SpCas9). The authors developed "enhanced specificity" SpCas9 (eSpCas9) variants which maintained robust on-target cleavage with reduced off-target effects.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,999,641, 8,993,233, 8,945,839, 8,932,814, 8,906,616, 8,895,308, 8,889,418, 8,889,356, 8,871,445, 8,865,406, 8,795,965, 8,771,945 and 8,697,359; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429), US 2015-0184139 (U.S. application Ser. No. 14/324,960), Ser. No. 14/054,414; European Patents EP 2 764 103 (EP13824232.6), EP 2 784 162 (EP14170383.5) and EP 2 771 468 (EP13818570.7); and PCT Patent Publications PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809), WO 2015/089351 (PCT/US2014/069897), WO 2015/089354 (PCT/US2014/069902), WO 2015/089364 (PCT/US2014/069925), WO 2015/089427 (PCT/US2014/070068), WO 2015/089462 (PCT/US2014/070127), WO 2015/089419 (PCT/US2014/070057), WO 2015/089465 (PCT/US2014/070135), WO 2015/089486 (PCT/US2014/070175), PCT/US2015/051691, PCT/US2015/051830. Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/836,127, 61/836,101, 61/836,080 and 61/835,973, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT Patent applications Nos: PCT/US2014/041803, PCT/US2014/041800, PCT/US2014/041809, PCT/US2014/041804 and PCT/US2014/041806, each filed Jun. 10, 2014; PCT/US2014/041808 filed Jun. 11, 2014; and PCT/US2014/62558 filed Oct. 28, 2014, and U.S. Provisional Patent Applications Ser. Nos. 61/915,148, 61/915,150, 61/915,153, 61/915,203, 61/915,251, 61/915,301, 61/915,267,61/915,260, and 61/915,397, each filed Dec. 12, 2013; 61/757,972 and 61/768,959, filed on Jan. 29, 2013 and Feb. 25, 2013; 61/835,936, 61/836,127, 61/836,101, 61/836,080, 61/835,973, and 61/835,931, filed Jun. 17, 2013; 62/010,888 and 62/010,879, both filed Jun. 11, 2014; 62/010,329 and 62/010,441, each filed Jun. 10, 2014; 61/939,228 and 61/939,242, each filed Feb. 12, 2014; 61/980,012, filed Apr. 15, 2014; 62/038,358, filed Aug. 17, 2014; 62/054,490, 62/055,484, 62/055,460 and 62/055,487, each filed Sep. 25, 2014; and 62/069,243, filed Oct. 27, 2014. Reference is made to U.S. provisional patent application 61/930,214 filed on Jan. 22, 2014.

Mention is also made of U.S. application 62/180,709, filed 17 Jun. 2015, PROTECTED GUIDE RNAS (PGRNAS); U.S. application 62/091,455, filed, 12 Dec. 2014, PROTECTED GUIDE RNAS (PGRNAS); U.S. application 62/096,708, 24 Dec. 2014, PROTECTED GUIDE RNAS (PGRNAS); U.S. application 62/091,462, 12 Dec. 2014, DEAD GUIDES FOR CRISPR TRANSCRIPTION FACTORS; U.S. application 62/096,324, 23 Dec. 2014, 62/180,681, 17 Jun. 2015, and 62/237,496, 5 Oct. 2015, DEAD GUIDES FOR CRISPR TRANSCRIPTION FACTORS; U.S. application 62/091,456, 12 Dec. 2014 and 62/180,692, 17 Jun. 2015, ESCORTED AND FUNCTIONALIZED GUIDES FOR CRISPR-CAS SYSTEMS; U.S. application 62/091,461, 12 Dec. 2014, DELIVERY, USE AND THERAPEUTIC APPLICATIONS OF THE CRISPR-CAS SYSTEMS AND COMPOSITIONS FOR GENOME EDITING AS TO HEMATOPOETIC STEM CELLS (HSCs); U.S. application 62/094,903,19 Dec. 2014, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24 Dec. 2014, ENGINEERING OF SYSTEMS, METHODS AND OPTIMIZED ENZYME AND GUIDE SCAFFOLDS FOR SEQUENCE MANIPULATION; U.S. application 62/098,059, 30 Dec. 2014 and 62/181,667,18 Jun. 2015, RNA-TARGETING SYSTEM; U.S. application 62/096,656, 24 Dec. 2014 and 62/181,151, 17 Jun. 2015, CRISPR HAVING OR ASSOCIATED WITH DESTABILIZATION DOMAINS; U.S. application 62/096,697, 24 Dec. 2014, CRISPR HAVING OR ASSOCIATED WITH AAV; U.S. application 62/098,158, 30 Dec. 2014, ENGINEERED CRISPR COMPLEX INSERTIONAL TARGETING SYSTEMS; U.S. application 62/151,052, 22 Apr. 2015, CELLULAR TARGETING FOR EXTRACELLULAR EXOSOMAL REPORTING; U.S. application 62/054,490, 24 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 61/939,154, 12 Feb. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/055,484, 25 Sep. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4 Dec. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24 Sep. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23 Oct. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/054,675, 24 Sep. 2014 and 62/181,002, 17 Jun. 2015, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24 Sep. 2014, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25 Sep. 2014, MULTIFUNCTIONAL-CRISPR COMPLEXES AND/OR OPTIMIZED ENZYME LINKED FUNCTIONAL-CRISPR COMPLEXES; U.S. application 62/087,475, 4 Dec. 2014, FUNCTIONAL SCREENING WITH OPTIMIZED FUNCTIONAL CRISPR-CAS SYSTEMS; U.S. application 62/055,487, 25 Sep. 2014, FUNCTIONAL SCREENING WITH OPTIMIZED FUNCTIONAL CRISPR-CAS SYSTEMS; U.S. application 62/087,546, 4 Dec. 2014 and 62/181,687, 18 Jun. 2015, MULTIFUNCTIONAL CRISPR COMPLEXES AND/OR OPTIMIZED ENZYME LINKED FUNCTIONAL-CRISPR COMPLEXES; and U.S. application 62/098,285, 30 Dec. 2014, CRISPR MEDIATED IN VIVO MODELING AND GENETIC SCREENING OF TUMOR GROWTH AND METASTASIS.

Mention is made of U.S. applications 62/181,659, 18 Jun. 2015 and 62/207,318, 19 Aug. 2015, ENGINEERING AND OPTIMIZATION OF SYSTEMS, METHODS, ENZYME AND GUIDE SCAFFOLDS OF CAS9 ORTHOLOGS AND VARIANTS FOR SEQUENCE MANIPULATION. Mention is made of U.S. applications 62/181,675, 18 Jun. 2015, and filed 22 Oct. 2015, NOVEL CRISPR ENZYMES AND SYSTEMS, U.S. application 62/232,067, 24 Sep. 2015, U.S. application 62/205,733, 16 Aug. 2015, U.S. application 62/201,542, 5 Aug. 2015, U.S. application 62/193,507, 16 Jul. 2015, and U.S. application 62/181,739, 18 Jun. 2015, each entitled NOVEL CRISPR ENZYMES AND SYSTEMS and of U.S. application 62/245,270, 22 Oct. 2015, NOVEL CRISPR ENZYMES AND SYSTEMS. Mention is also made of U.S. application 61/939,256, 12 Feb. 2014, and WO 2015/089473 (PCT/US2014/070152), 12 Dec. 2014, each entitled ENGINEERING OF SYSTEMS, METHODS AND OPTIMIZED GUIDE COMPOSITIONS WITH NEW ARCHITECTURES FOR SEQUENCE MANIPULATION. Mention is also made of PCT/US2015/045504, 15 Aug. 2015, U.S. application 62/180,699, 17 Jun. 2015, and U.S. application 62/038,358, 17 Aug. 2014, each entitled GENOME EDITING USING CAS9 NICKASES.

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

In addition, mention is made of PCT application PCT/US14/70057, and BI-2013/107 entitled "DELIVERY, USE AND THERAPEUTIC APPLICATIONS OF THE CRISPR-CAS SYSTEMS AND COMPOSITIONS FOR TARGET- ING DISORDERS AND DISEASES USING PARTICLE DELIVERY COMPONENTS (claiming priority from one or more or all of U.S. provisional patent application 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, with respect to a method of preparing an sgRNA-and-Cas9 protein containing particle comprising admixing a mixture comprising an sgRNA and Cas9 protein (and optionally HDR template) with a mixture comprising or consisting essentially of or consisting of surfactant, phospholipid, biodegradable polymer, lipoprotein and alcohol; and particles from such a process. For example, wherein Cas9 protein and sgRNA were mixed together at a suitable, e.g., 3:1 to 1:3 or 2:1 to 1:2 or 1:1 molar ratio, at a suitable temperature, e.g., 15-30 C, e.g., 20-25 C, e.g., room temperature, for a suitable time, e.g., 15-45, such as 30 minutes, advantageously in sterile, nuclease free buffer, e.g., 1×PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a $C_1$ alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Cas9 protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. That application accordingly comprehends admixing sgRNA, Cas9 protein and components that form a particle; as well as particles from such admixing. Aspects of the instant invention can involve particles; for example, particles using a process analogous to that of the Particle Delivery PCT, e.g., by admixing a mixture comprising sgRNA and/or Cas9 as in the instant invention and components that form a particle, e.g., as in the Particle Delivery PCT, to form a particle and particles from such admixing (or, of course, other particles involving sgRNA and/or Cas9 as in the instant invention).

The present invention will be further illustrated in the following Examples which are given for illustration purposes only and are not intended to limit the invention in any way.

EXAMPLES

Example 1: Origin and Evolution of Adaptive Immunity Systems

Classification and annotation of CRISPR-Cas systems in archaeal and bacterial genomes. The CRISPR-Cas loci has more than 50 gene families and there is no strictly universal genes, fast evolution, extreme diversity of loci architecture. Therefore, no single tree feasible and a multi-pronged approach is needed. So far, there is comprehensive cas gene identification of 395 profiles for 93 Cas proteins. Classification includes signature gene profiles plus signatures of locus architecture A new classification of CRISPR-Cas systems is proposed in FIG. 1A-1B. Class 1 includes multisubunit crRNA-effector complexes (Cascade) and Class 2 includes Single-subunit crRNA-effector complexes (Cas9-like). FIG. 2 provides a molecular organization of CRISPR-Cas. FIG. 3A-3D provides structures of Type I and III effector complexes: common architecture/common ancestry despite extensive sequence divergence. FIG. 4 shows CRISPR-Cas as a RNA recognition motif (RRM)-centered system. FIG. 5 shows Cas1 phylogeny where recombination of adaptation and crRNA-effector modules show a major aspect of CRISPR-Cas evolution. FIG. 6 shows a CRISPR-Cas census, specifically a distribution of CRISPR-Cas types/subtypes among archaea and bacteria.

Cas1 is not always linked to CRISPR-Cas systems, therefore it may be possible that there are two branches of "solo" Cas1 which suggests there may be differences in function and origin and possible novel mobile elements (see Makarova, Krupovic, Koonin, Frontiers Genet 2014). The genome organization of three casposon families may provide some clues. In addition to Cas1 and PoB, casposons incorporate diverse genes including various nucleases (Krupovic et al. BMC Biology 2014). One family has protein-primed polymerase, another family has RNA-primed polymerase. In addition to diverse Euryarchaeota and Thaumarchaeota, casposons found in several bacteria which suggests horizontal mobility. Casposon Cas1 (transposasentegrase) suggests a basal clade in the Cas1 phylogeny.

Bacteria and archae utilize CRISPR for adaptive immunity in procaryotes and eukaryotes via genome manipulation. Cas 1 provides a ready-made tool for genome manipulation. There are similar mechanisms of integration in casposons and CRISPR, specifically replication-dependent acquisition by copy/paste not cut-and-paste (Krupovic et al. BMC Biology 2014). Cas1 is a bona fide integrase (Nuftez J K, Lee A S, Engelman A, Doudna J A. Integrase-mediated spacer acquisition during CRISPR-Cas adaptive immunity. Nature. 2015 Feb. 18). There is similarity between terminal inverted repeats of casposons and CRISPR (Krupovic et al. BMC Biology 2014). CRISPR-Cas may have originated from a casposon and an innate immunity locus (Koonin, Krupovic, Nature Rev Genet, 2015). The evolution of adaptive immunity systems in prokaryotes and animals may have been along parallel courses with transposon integration at innate immunity loci (Koonin, Krupovic, Nature Rev Genet, 2015). RAG1 transposase (the key enzyme of V(D)J recombination in vertebrates) may have originated from Transib transposons (Kapitonov V V, Jurka J. RAG1 core and V(D)J recombination signal sequences were derived from Transib transposons. PLoS Biol. 2005 June; 3(6):e81), however, none of the Transibs encodes RAG2. RAG1 and RAG2 encoding transposons are described in Kapitonov, Koonin, Biol Direct 2015 and Transib transposase phylogeny is presented in Kapitonov, Koonin, Biol Direct 2015. Defensive DNA elimination in ciliates evolved from a PiggyMAc transposon and RNAi, an innate immune system (Swart E C, Nowacki M. The eukaryotic way to defend and edit genomes by sRNA-targeted DNA deletion. Ann NY Acad Sci. 2015).

The relative stability of the classification implies that the most prevalent variants of CRISPR-Cas systems are already known. However, the existence of rare, currently unclassifiable variants implies that additional types and subtypes remain to be characterized (Makarova et al. 2015. Evolutionary classification of CRISPR-Cas systems and cas genes).

Transposons play a key contribution to the evolution of adaptive immunity and other systems involved in DNA manipulation. Class 1 CRISPR-Cas originate from transposons but only for an adaptation module. Class 2 CRISPR-Cas have both adaptation and effector functions where modules may have evolved from different transposons.

Figure 1A:
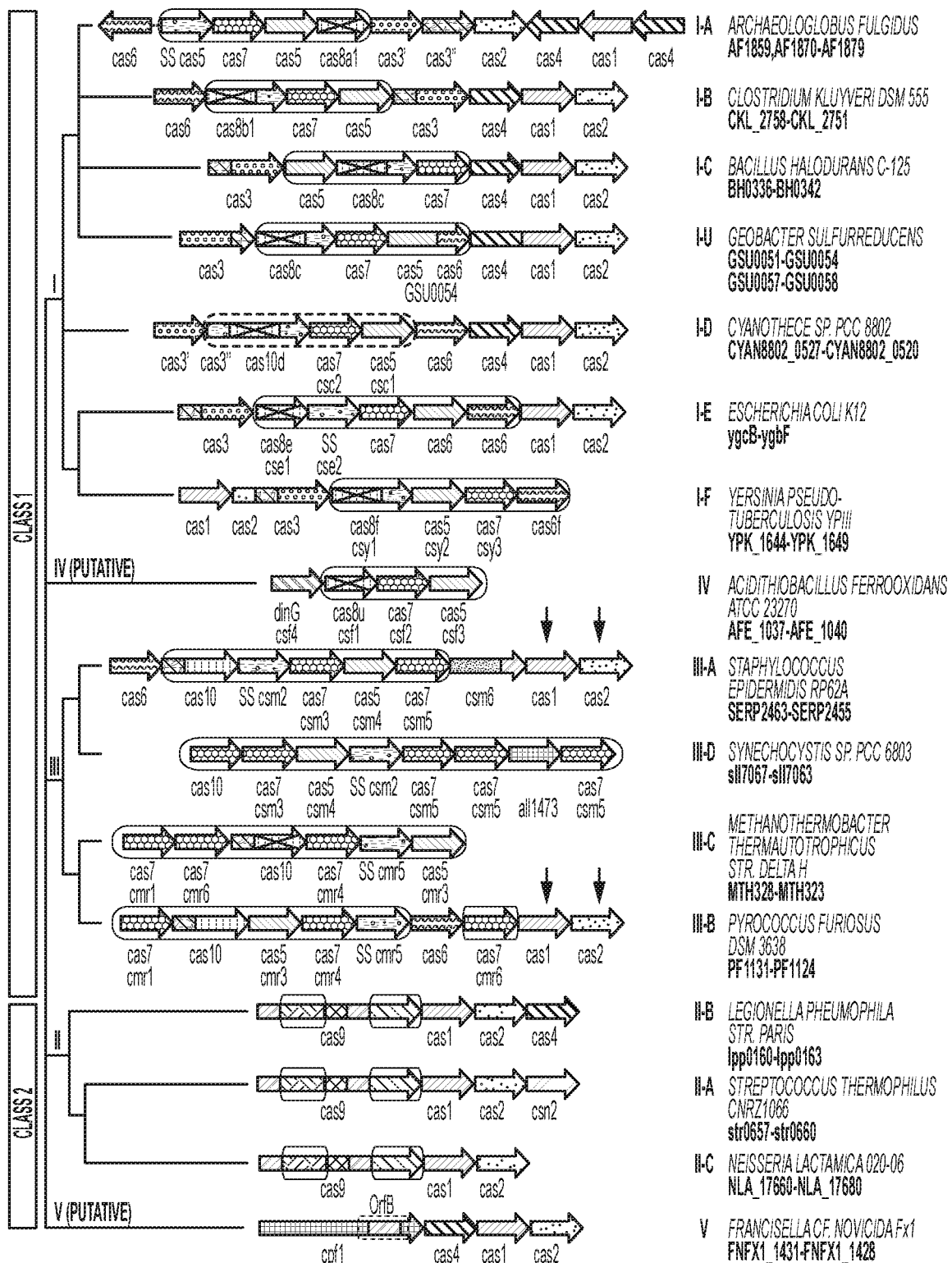
FIGS. 1A-1B depicts a new classification of CRISPR-Cas systems. Class 1 includes multisubunit crRNA-effector complexes (Cascade) and Class 2 includes Single-subunit crRNA-effector complexes (Cas9-like).
Figure 1B:
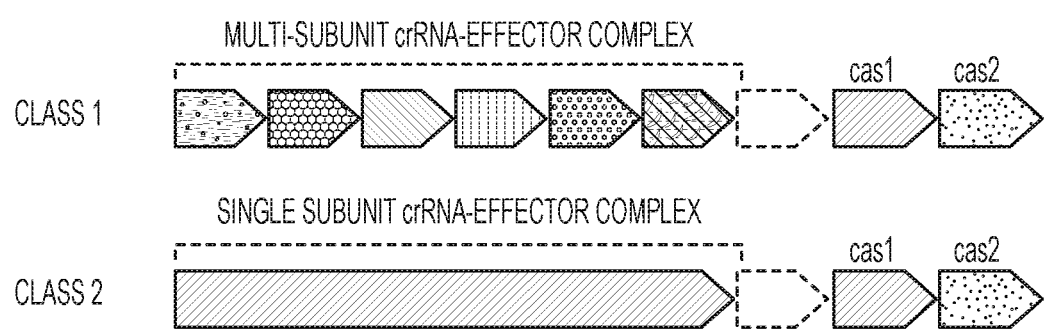
Figure 7:
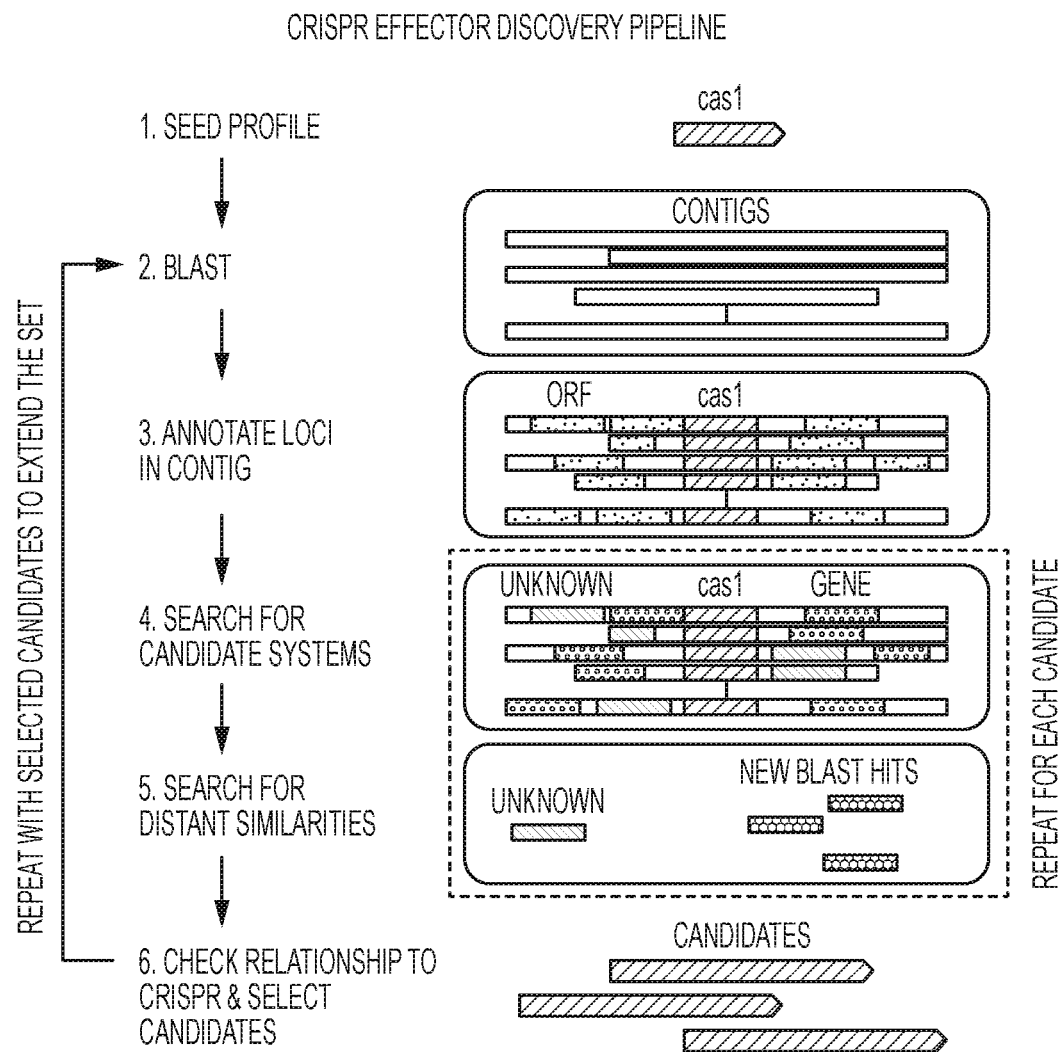
FIG. 7 depicts a pipeline for identifying Cas candidates.

Example 2: New Predicted Class 2 CRISPR-Cas Systems and Evidence of their Independent Origins from Transposable Elements The CRISPR-Cas systems of bacterial and archaeal adaptive immunity show extreme diversity of protein composition and genomic loci architecture. These systems are broadly divided into two classes, Class 1 with multisubunit effector complexes and Class 2 with single-subunit effector modules exemplified by the Cas9 protein (FIGS. 1A and 1B). Applicants developed a simple computational pipeline (FIG. 7) to leverage the expanding genomic and metagenomic databases along with our current understanding of CRISPR-Cas systems for prediction of putative new Class 2 CRISPR-Cas systems. Analysis of the database of complete bacterial genomes using this pipeline resulted in the identification of three new variants, each represented in diverse bacteria and containing cas and cas2 genes along with a third gene encoding a large protein predicted to function as the effector module. In the first of these loci, the putative effector protein (C2c1p) contains a RuvC-like nuclease domain and resembles the previously described Cpf1 protein, the predicted effector of Type V CRISPR-Cas systems; accordingly, the new putative system is classified as subtype V-B. In depth comparison of protein sequences suggests that the RuvC-containing effector proteins, Cas9, Cpf1 and C2C1p independently evolved from different groups of transposon-encoded TnpB proteins. The second group of new putative CRISPR-Cas loci encompasses a large protein containing two highly diverged HEPN domains with predicted RNAse activity. Given the novelty of the predicted effector protein, these loci are classified as new Type VI CRISPR-Cas that is likely to target mRNA. Together, the results of this analysis show that Class2 CRISPR-Cas systems evolved on multiple, independent occasions, by combination of diverse Cas1-Cas2-encoding adaptation modules with effector proteins derived from different mobile elements. This route of evolution most likely produced multiple variants of Class 2 systems that remain to be discovered.

The CRISPR-Cas adaptive immunity systems are present in ~45% bacterial and 90% archaeal genomes and show extreme diversity of Cas protein composition and sequence, and genomic loci architecture. Based on the structural organization of their crRNA-effector complexes, these systems are divided into two classes, namely class 1, with multisubunit effector complexes, and class 2, with single subunit effector complexes (Makarova, 2015) (FIGS. 1A and 1B). Class 1 systems are much more common and diverse than Class 2 systems. Class 1 currently is represented by 12 distinct subtypes encoded by numerous archaeal and bacterial genomes, whereas class 2 systems include three subtypes of Type II system and the putative Type V that collectively are found in about 10% of sequenced bacterial genomes (with a single archaeal genome encompassing a putative Type system). Class 2 systems typically contain only three or four genes in the cas operon, namely the cas1-cas2 pair of genes that are involved in adaptation but not in interference, a single multidomain effector protein that is responsible for interference but also contributes to the pre-crRNA processing and adaptation, and often a fourth gene with uncharacterized functions that is dispensable in at least some Type II systems. In most cases, a CRISPR array and a gene for a distinct RNA species known as tracrRNA (trans-encoded small CRISPR RNA) are adjacent to Class 2 cas operons (Chylinski, 2014). The tracrRNA is partially homologous to the repeats within the respective CRISPR array and is essential for the processing of pre-crRNA that is catalyzed by RNAse III, a ubiquitous bacterial enzyme that is not associated with the CRISPR-cas loci (Deltcheva, 2011) (Chylinski, 2014; Chylinski, 2013).

The Type II multidomain effector protein Cas9 has been functionally and structurally characterized in exquisite detail. In different bacteria, Cas9 proteins encompass from about 950 to over 1,600 amino acids, such as between about 950 and 1,400 amino acids, and contain two nuclease domains, namely a RuvC-like (RNase H fold) and HNH (McrA-like) nucleases (Makarova, 2011). The crystal structure of Cas9 reveals a bilobed organization of the protein, with distinct target recognition and nuclease lobes, with the latter accommodating both the RuvC and the HNH domains (Nishimasu, 2014) (Jinek, 2014). Each of the nuclease domains of Cas9 is required for the cleavage of one of the target DNA strands (Jinek, 2012; Sapranauskas, 2011). Recently, Cas9 has been shown to contribute to all three stages of the CRISPR response, that is not only target DNA cleavage (interference) but also adaptation and pre-crRNA processing (Jinek, 2012). More specifically, a distinct domain in the nuclease lobe of Cas9 has been shown to recognize and bind the Protospacer-Associated Motif (PAM) in viral DNA during the adaptation stage (Nishimasu, 2014) (Jinek, 2014) (Heler, 2015; Wei, 2015). At this stage of the CRISPR response, Cas9 forms a complex with Cas1 and Cas2, the two proteins that are involved in spacer acquisition in all CRISPR-Cas systems (Heler, 2015; Wei, 2015).

The Cas9 protein, combined with tracrRNA, has recently become the key tool for the new generation of genome editing and engineering methods (Gasiunas, 2013; Mali, 2013; Sampson, 2014; Cong, 2015). This utility of Cas9 in genome editing hinges on the fact that in Type II CRISPR-Cas systems, unlike other types of CRISPR-Cas systems, all the activities required for the target DNA recognition and cleavage are assembled within a single, albeit large, multidomain protein. This feature of Type II systems greatly facilitates the design of efficient tools for genome manipulation. Importantly, not all variants of Cas9 are equal. Most of the work so far has been done with Cas9 from *Streptococcus pyogenes* but other Cas9 species could offer substantial advantages. As a case in point, recent experiments with Cas9 from *Staphylococcus aureus* that is about 300 amino acids shorter than the *S. pyogenes* protein have allowed Cas9 packaging into the adeno-associated virus vector, resulting in a major enhancement of CRISPR-Cas utility for genome editing in vivo (Ran, 2015).

Type II CRISPR-Cas systems currently are classified into 3 subtypes (II-A, II—B and II-C) (Makarova, 2011) (Fonfara, 2014; Chylinski, 2013; Chylinski, 2014). In addition to the cas1, cas2 and cas9 genes that are shared by all Type II loci, subtype II-A is characterized by an extra gene, csn2, that encodes an inactivated ATPase (Nam, 2011; Koo, 2012; Lee, 2012) that plays a still poorly characterized role in spacer acquisition (Barrangou, 2007; Arslan, 2013) (Heler, 2015). Subtype II-B systems lack csn2 but instead contains the cas4 gene that is otherwise typical of Type I systems and encodes a recB family 5'-3' exonuclease that contributes to spacer acquisition by generating recombinogeneci DNA ends (Zhang, 2012) (Lemak, 2013; Lemak, 2014). The cas1 and cas2 genes of subtype II-B are most closely related to the respective proteins of Type I CRISPR-Cas systems which implies a recombinant origin of this Type II subtype (Chylinski, 2014).

Subtype II-C CRISPR-Cas systems are the minimal variety that consists only of the cas1, cas2 and cas9 genes (Chylinski, 2013; Koonin, 2013; Chylinski, 2014). Notably, however, it has been shown that in *Campylobacter jejuni* spacer acquisition by the Type II-C systems requires the participation of Cas4 encoded by a bacteriophage (Hooton, 2014). Another distinct feature of subtype II-C is the formation of some of the crRNAs by transcription involves transcription from internal alternative promoters as opposed to processing observed in all other experimentally characterized CRISPR-Cas systems (Zhang, 2013).

Recently, the existence of Type V CRISPR-Cas systems has been predicted by comparative analysis of bacterial genomes. These putative novel CRISPR-Cas systems are represented in several bacterial genomes, in particular those from the genus *Francisella* and one archaeon, *Methanomethylophilus alvus* (Vestergaard, 2014). All putative Type V loci encompass cas1, cas2, a distinct gene denoted cpf1 and a CRISPR array (Schunder, 2013) (Makarova, 2015). Cpf1 is a large protein (about 1300 amino acids) that contains a RuvC-like nuclease domain homologous to the corresponding domain of Cas9 along with a counterpart to the characteristic arginine-rich cluster of Cas9. However, Cpf1 lacks the HNH nuclease domain that is present in all Cas9 proteins, and the RuvC-like domain is contiguous in the Cpf1 sequence, in contrast to Cas9 where it contains long inserts including the HNH domain (Chylinski, 2014; Makarova, 2015). These major differences in the domain architectures of Cas9 and Cpf1 suggest that the Cpf1-containing systems should be classified as a new type. The composition of the putative Type V systems implies that Cpf1 is a single-subunit effector complex, and accordingly, these systems are assigned to Class 2 CRISPR-Cas. Some of the putative Type V loci encode Cas4 and accordingly resemble subtype II-B loci, whereas others lack Cas4 and thus are analogous to subtype II-C.

It has been shown that the closest homologs of Cas9 and Cpf1 proteins are TnpB proteins that are encoded in IS605 family transposons and contain the RuvC-like nuclease domain as well as a Zn-finger that has a counterpart in Cpf1. In addition, homologs of TnpB have been identified that contain a HNH domain inserted into the RuvC-like domain and show high sequence similarity to Cas9. The role of TnpB in transposons remains uncertain as it has been shown that this protein is not required for transposition.

Given the homology of Cas9 and Cpf1 to transposon-encoded proteins, Applicants hypothesized that Class 2 CRISPR-Cas systems could have evolved on multiple occasions as a result of recombination between a transposon and a cas1-cas2 locus. Accordingly, Applicants devised a simple computational strategy to identify genomic loci that could be candidates for novel variants of Class 2. Here Applicants describe the first application of this approach that resulted in the identification of three groups of such candidates two of which appear to be distinct subtypes of Type V whereas the third one seems to qualify at Type VI. The new variants of Class2 CRISPR-Cas systems are of obvious interest as potential tools for genome editing and expression regulation.

Figure 8A:
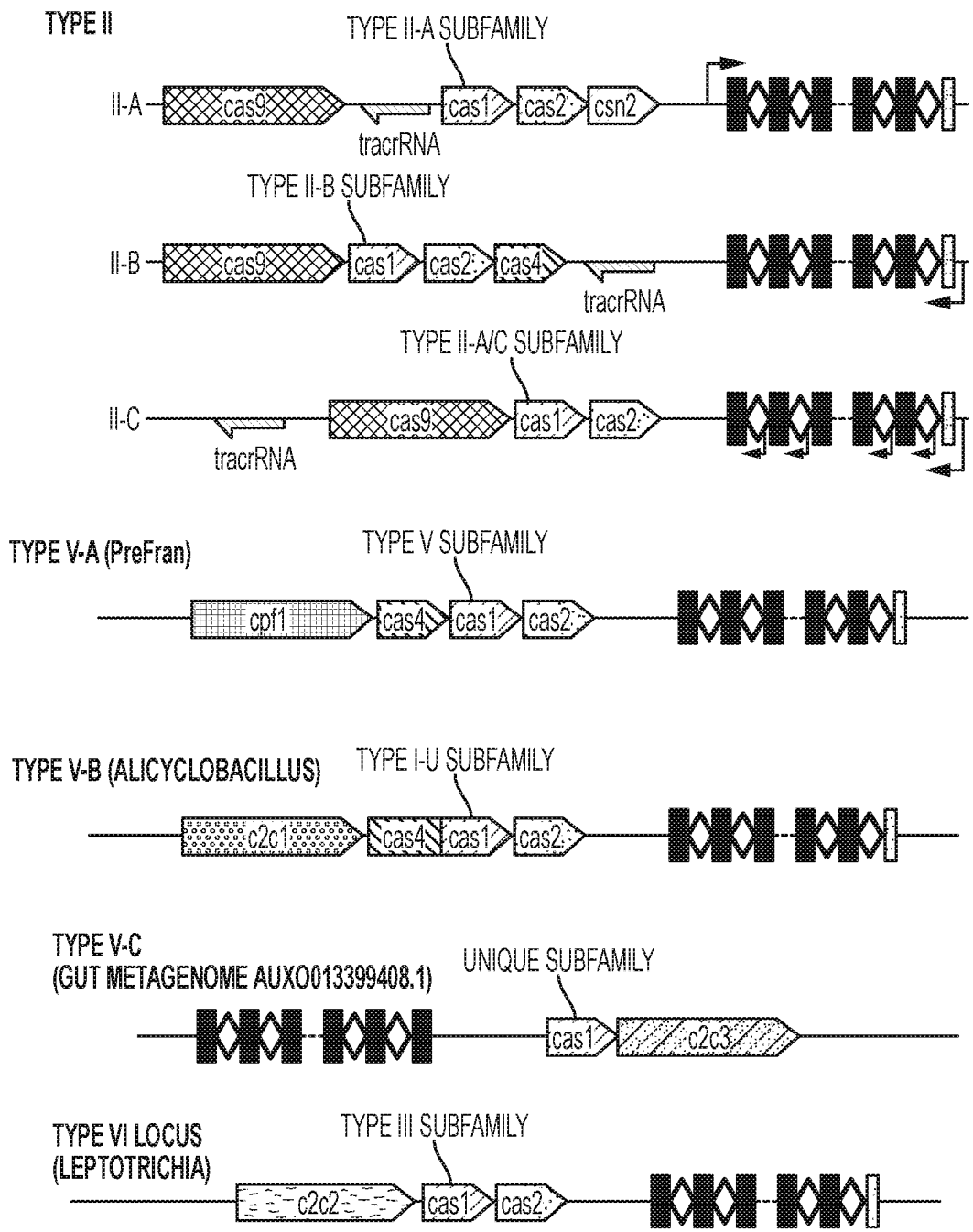
FIGS. 8A-8B depicts an organization of complete loci of Class 2 CRISPR-Cas systems. The three subtypes of type II and subtypes V-A, V-B and V-C, and type VI are indicated. Subfamilies based on Cas1 are also indicated. The schematics include only the common genes represented in each subtype; the additional genes present in some variants are omitted. The rectangle shows the degenerate repeat. The gray arrows show the direction of CRISPR array transcription. PreFran, *Prevotella-Francisella*.
Figure 8B:
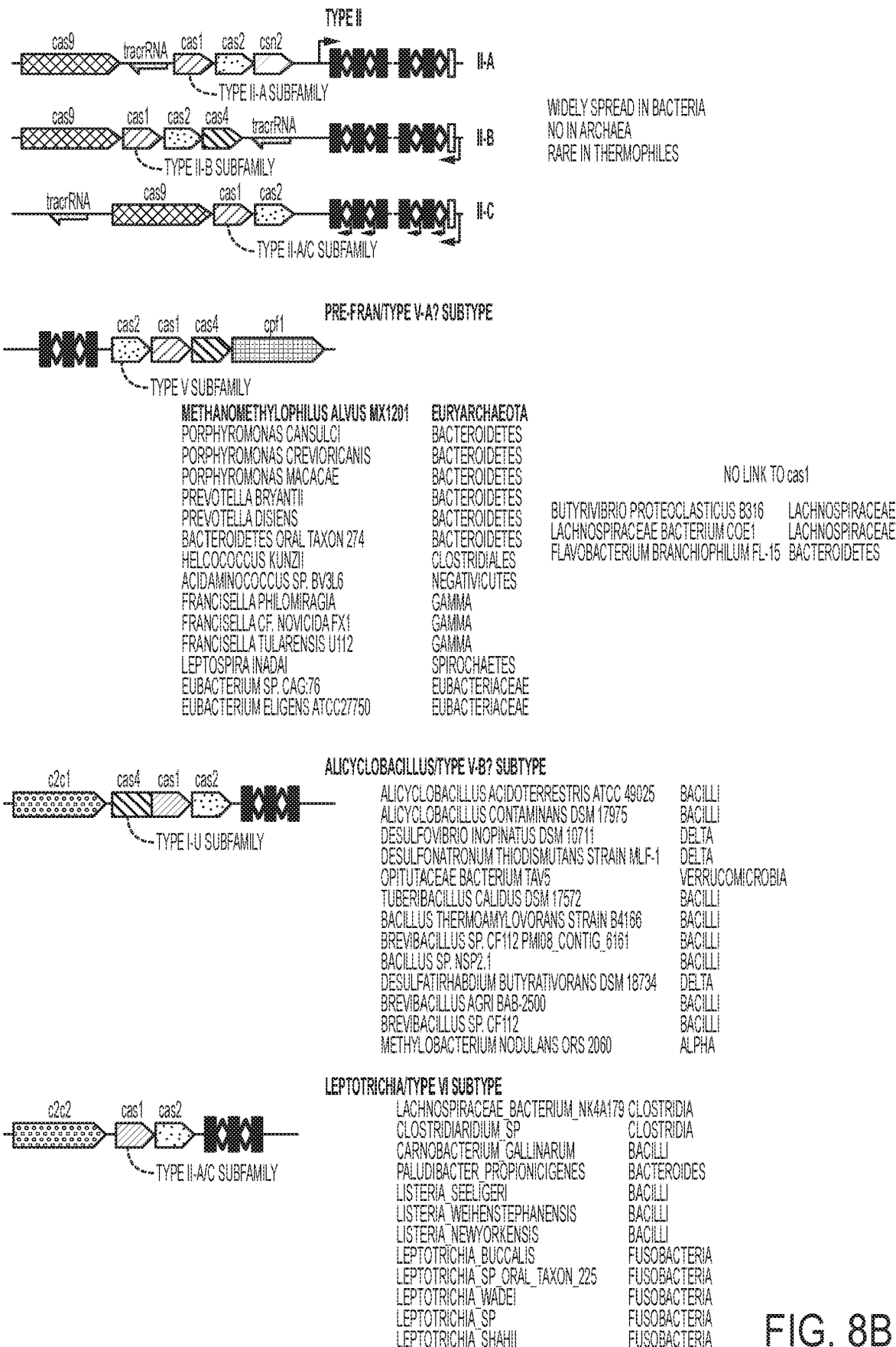
Figure 9:
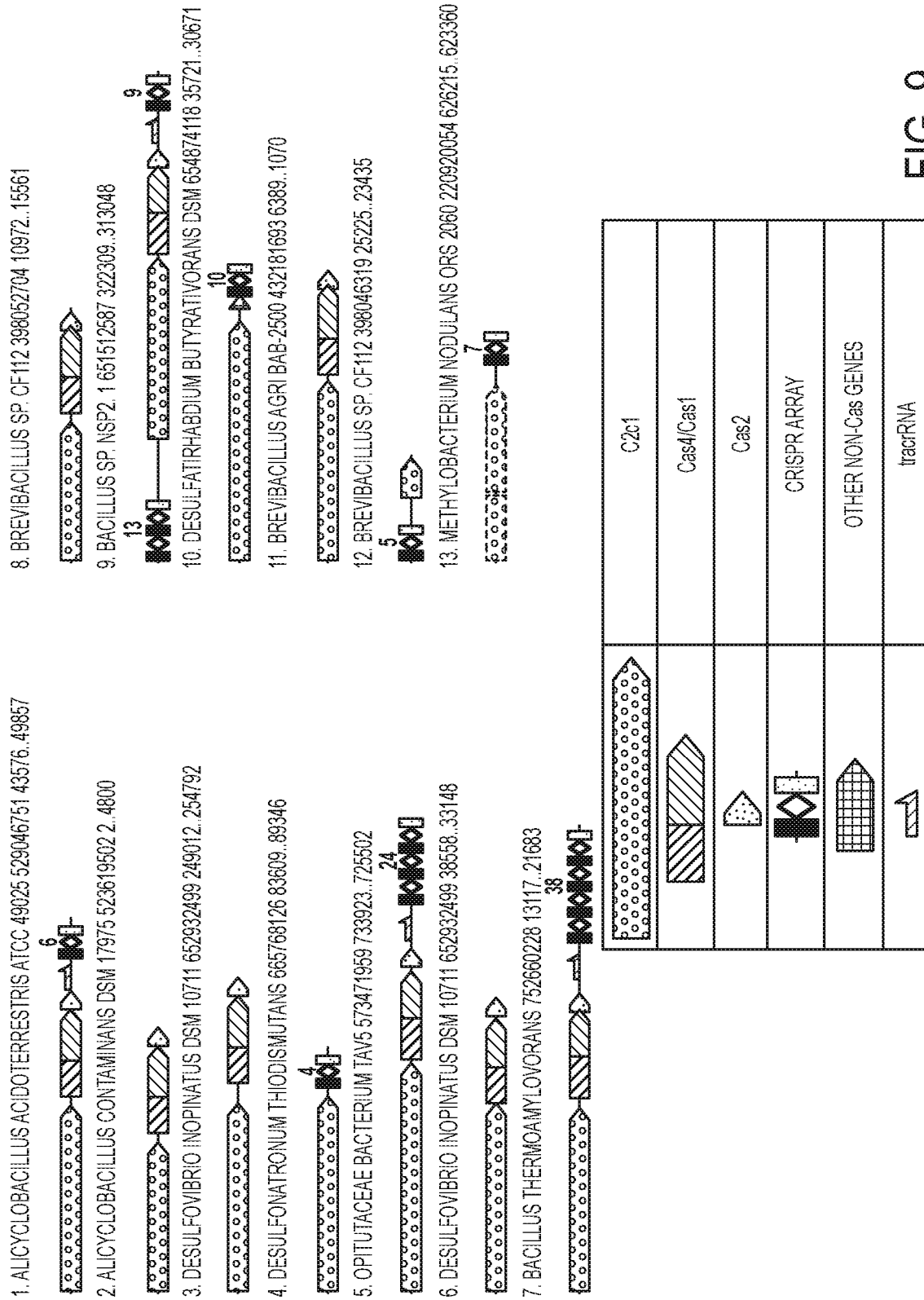
FIG. 9 depicts C2c1 neighborhoods, i.e., genomic architecture of the C2c1 CRISPR-Cas loci. The number of repeats in CRISPR arrays is indicated. For each genomic contig, Genbank numeric ID and the coordinates of the locus are indicated.
Figure 14:
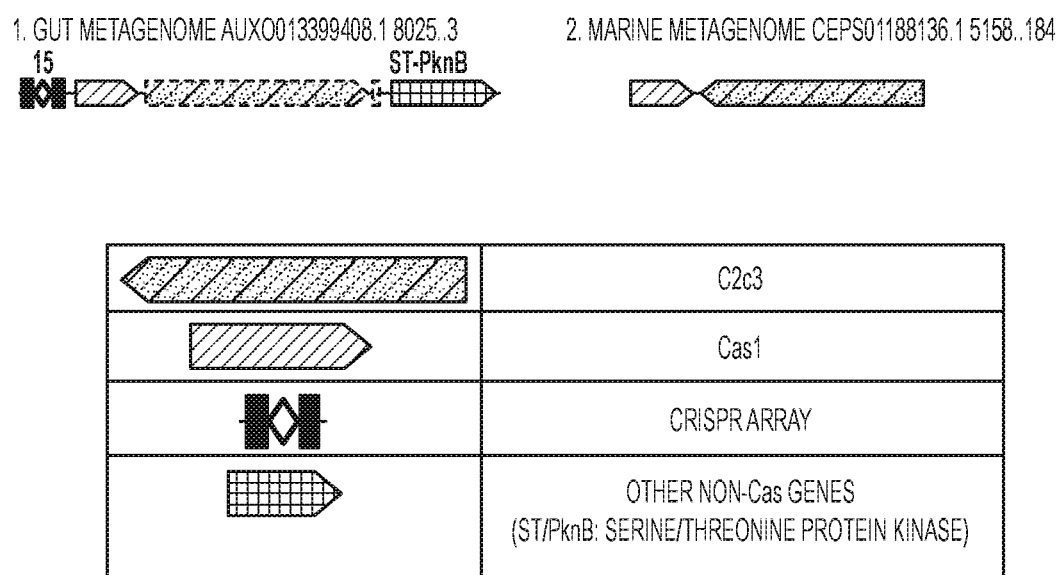
FIG. 14 depicts C2c3 neighborhoods, i.e., genomic architecture of the C2c3 CRISPR-Cas loci. The number of repeats in CRISPR arrays is indicated. For each genomic contig, Genbank numeric ID and the coordinates of the locus are indicated.
Figure 15:
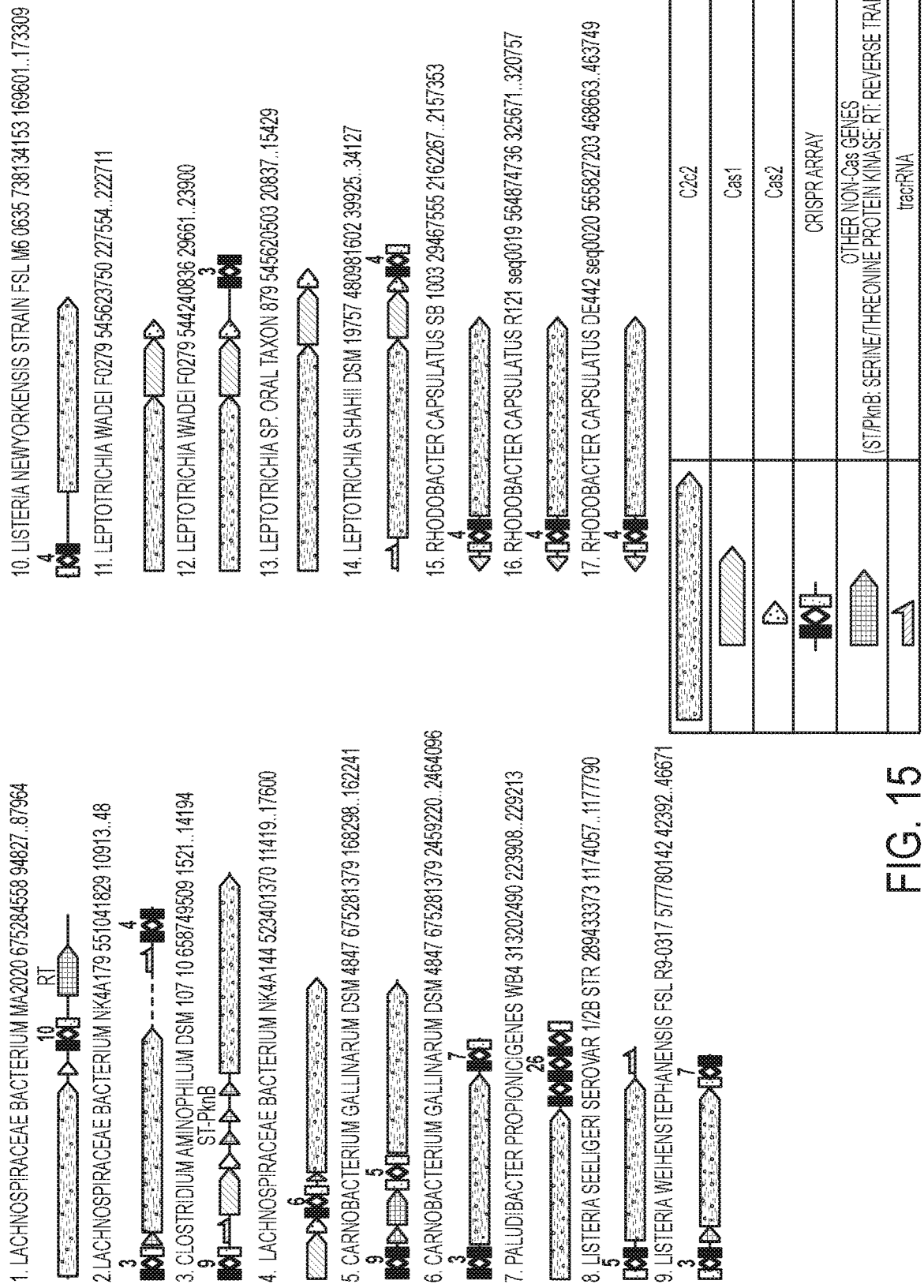
FIG. 15 depicts C2c2 neighborhoods.
Figure 17:
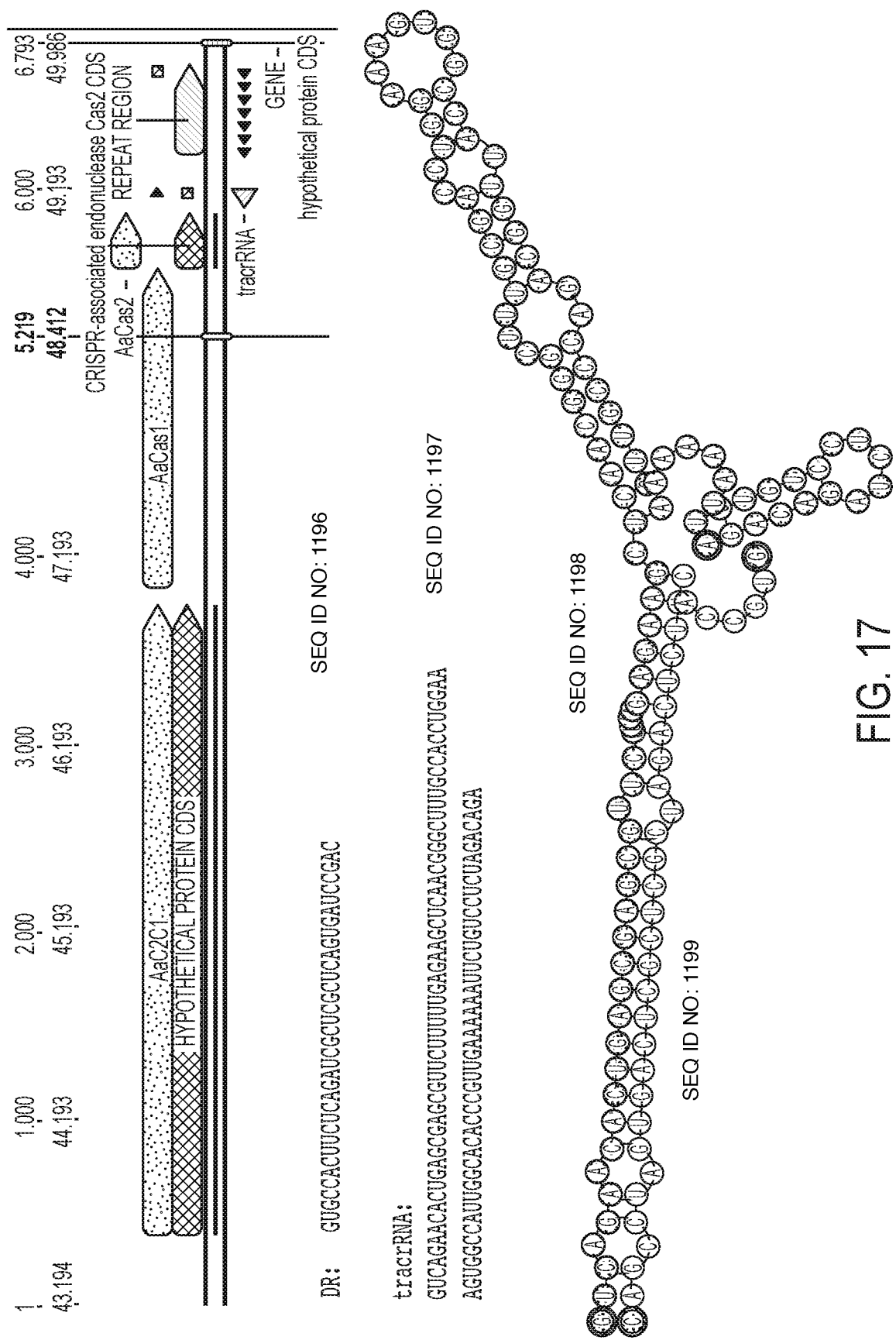
FIG. 17 depicts C2C1: 1. *Alicyclobacillus acidoterrestris* ATCC 49025. Figure discloses SEQ ID NOS 1196-1199, respectively, in order of appearance.
Figure 18:
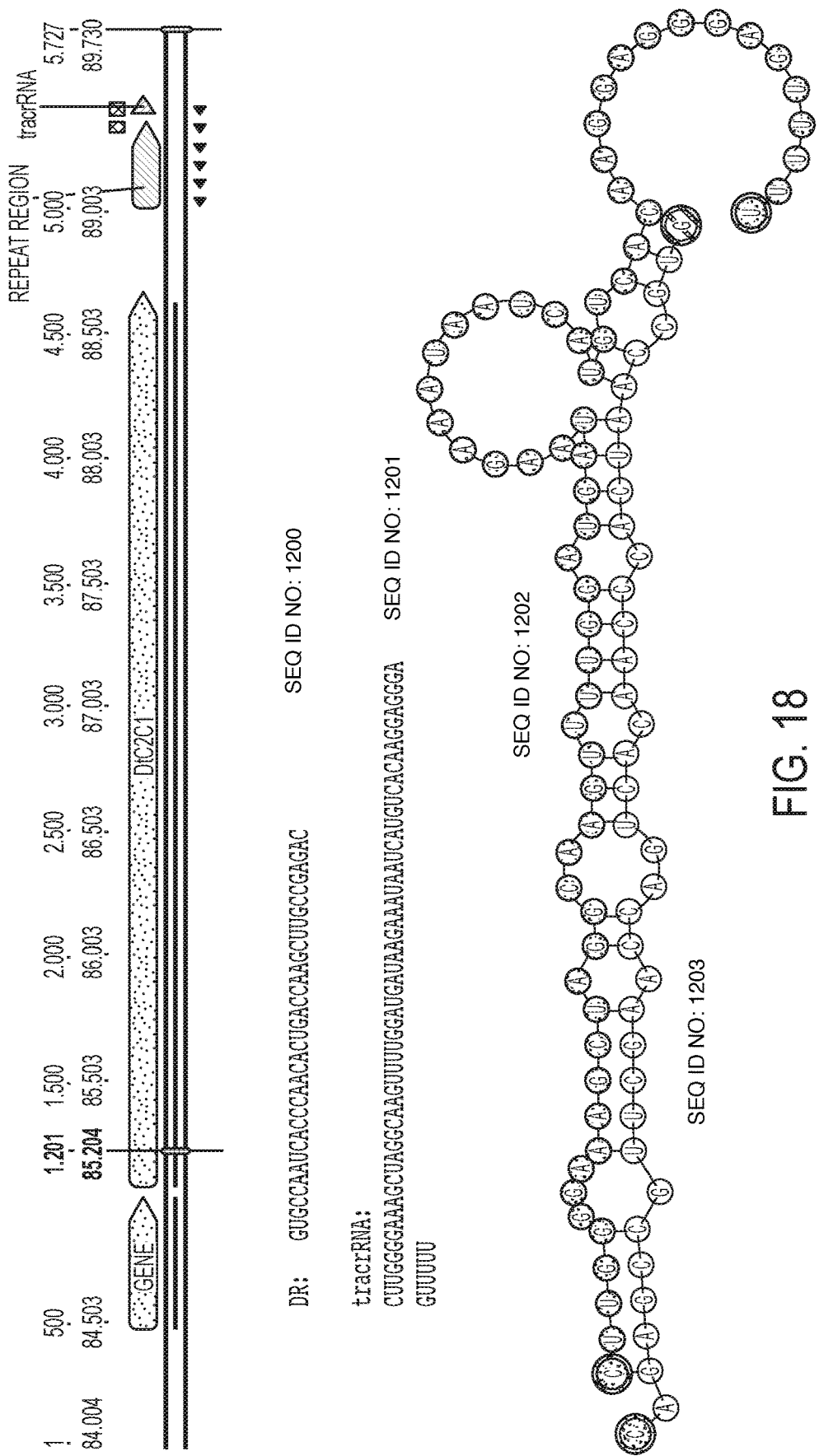
FIG. 18 depicts C2C1: 4. *Desulfonatronum thiodismutans* strain MLF-1. Figure discloses SEQ ID NOS 1200-1203, respectively, in order of appearance.
Figure 20:
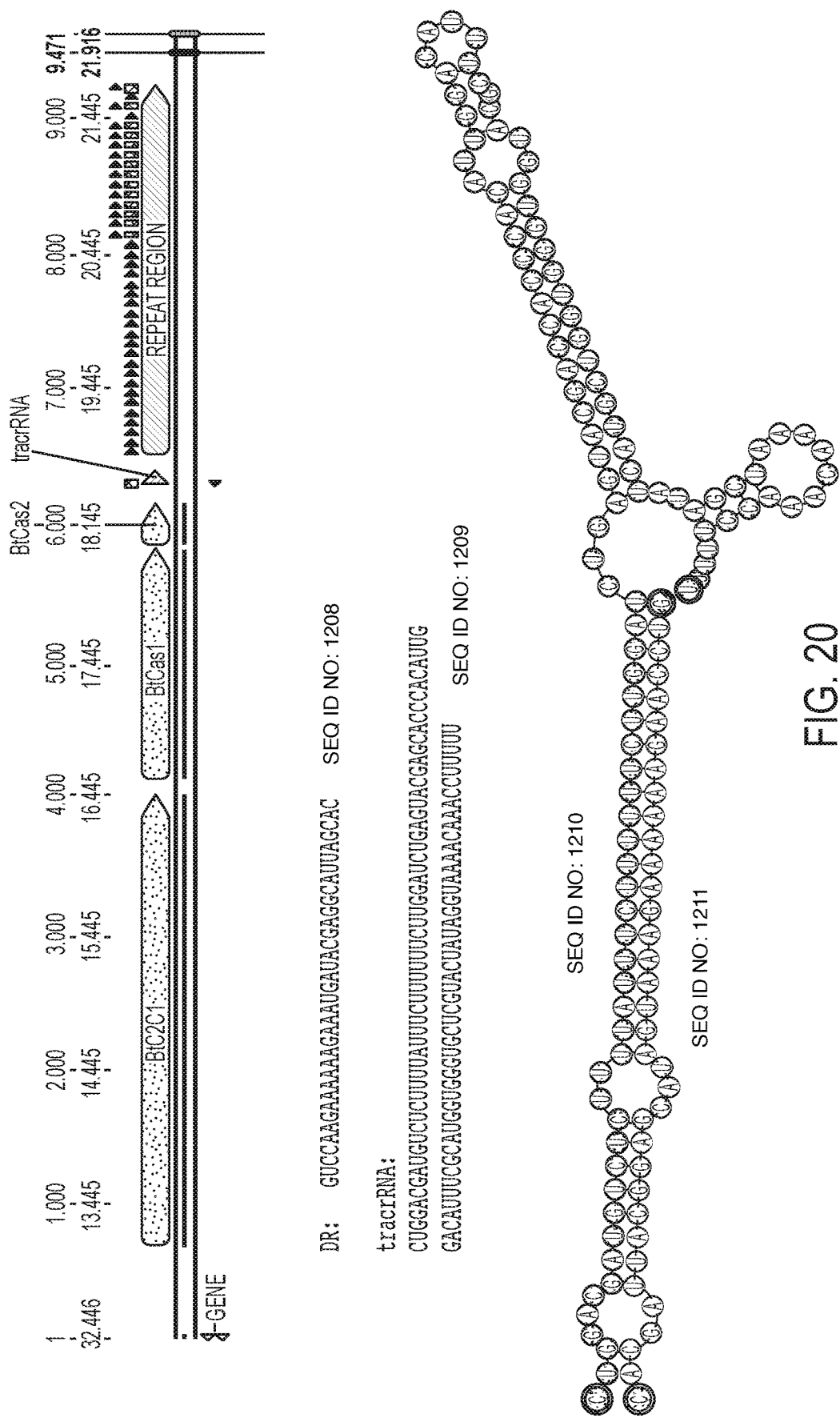
FIG. 20 depicts C2C1: 7. *Bacillus thermoamylovorans* strain B4166. Figure discloses SEQ ID NOS 1208-1211, respectively, in order of appearance.
Figure 22:
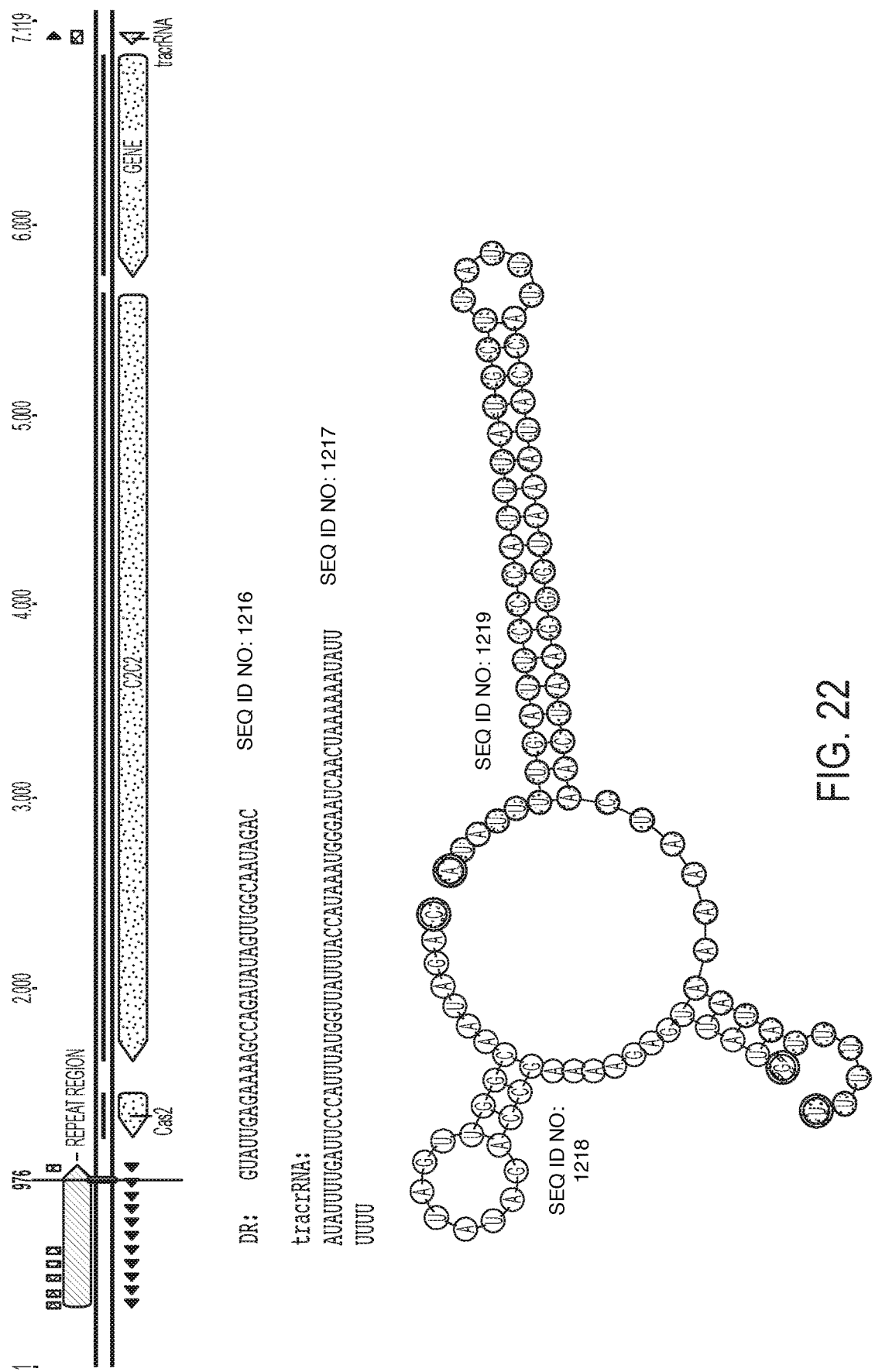
FIG. 22 depicts C2C2: 1. Lachnospiraceae bacterium MA2020. Figure discloses SEQ ID NOS 1216-1219, respectively, in order of appearance.
Figures 1, 23:
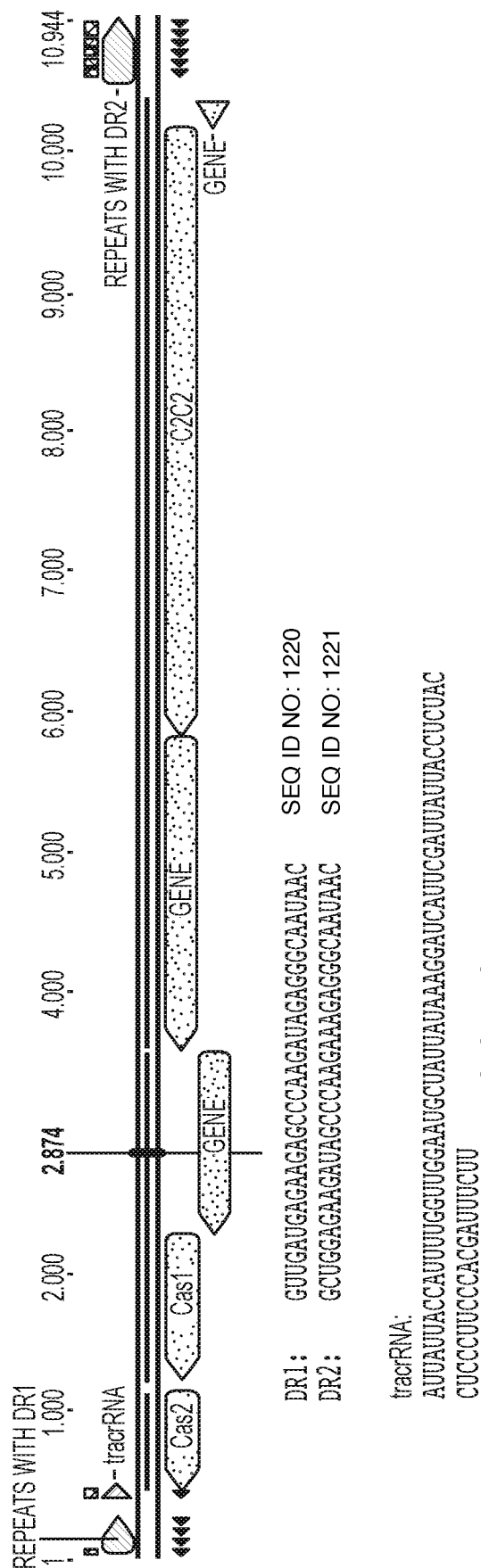
Figures 2, 23:
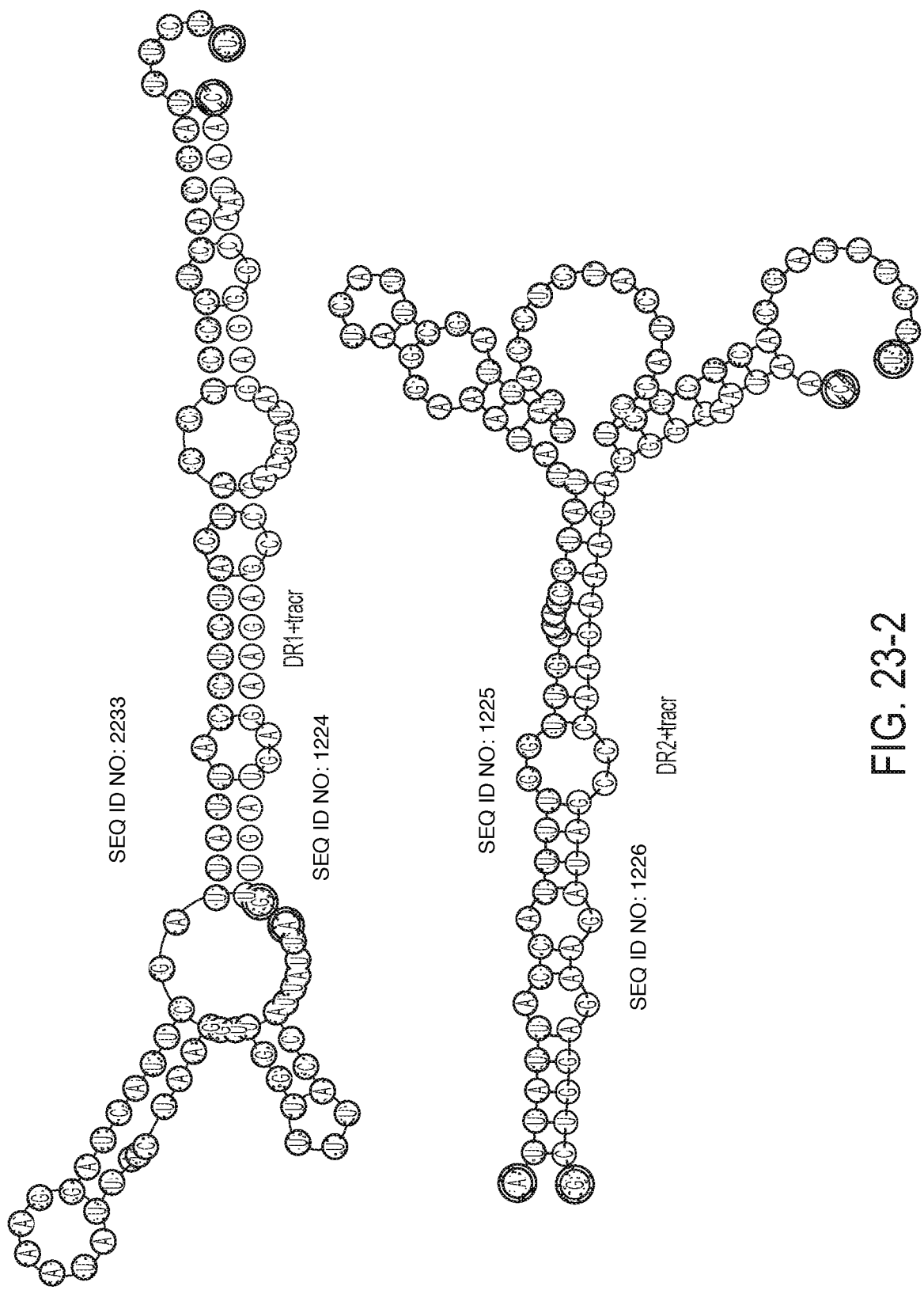
Figure 24:
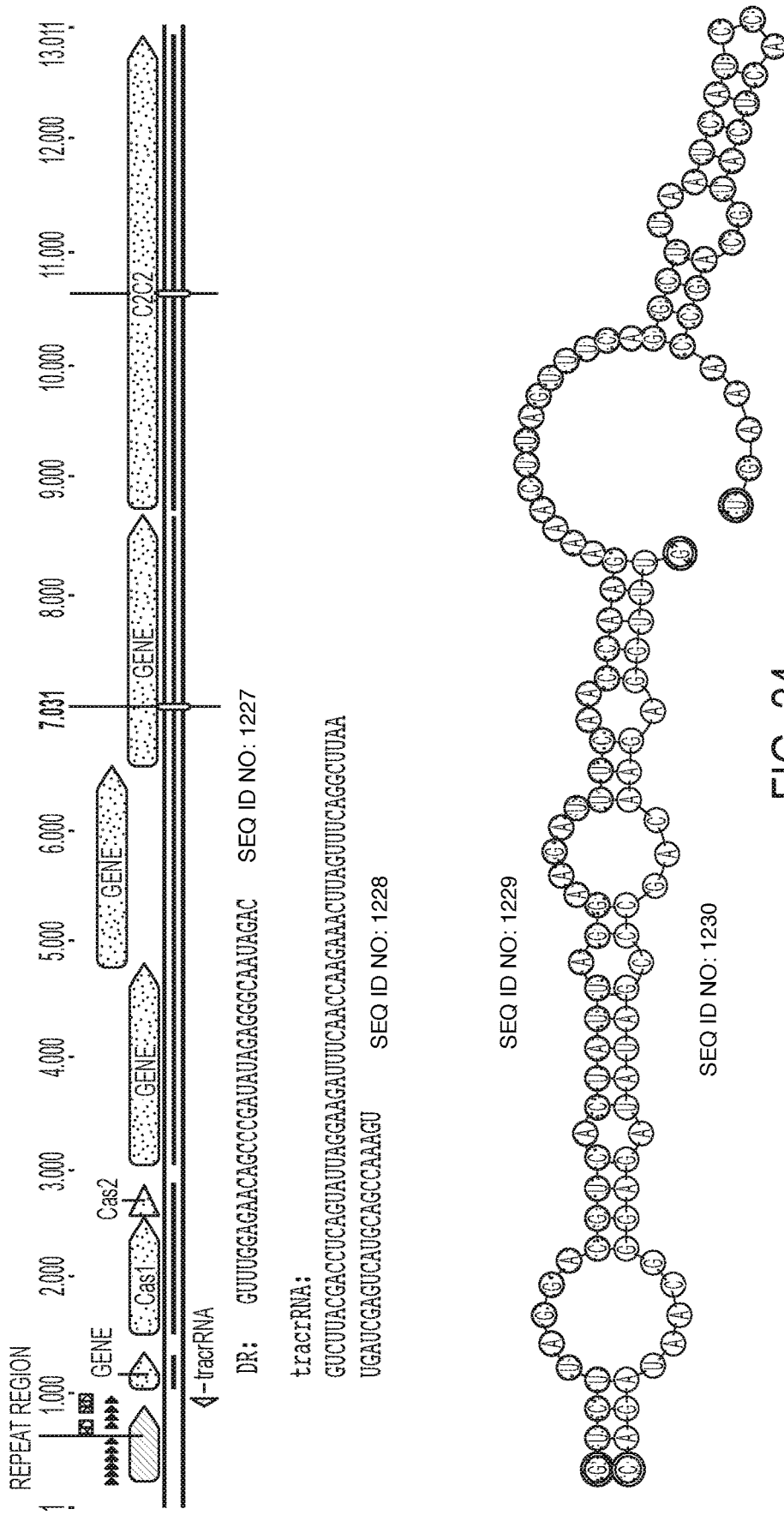
FIG. 24 depicts C2C2: 3. [*Clostridium*] *aminophilum* DSM 10710. Figure discloses SEQ ID NOS 1227-1230, respectively, in order of appearance.
Figure 25:
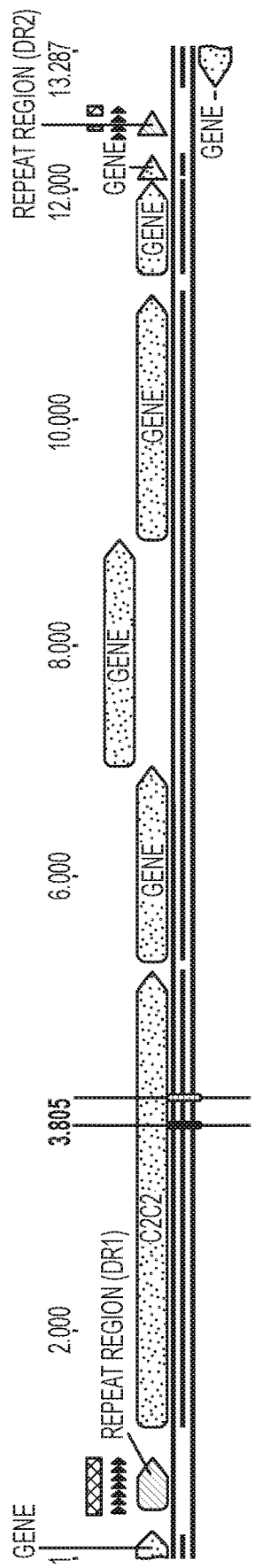
FIG. 25 depicts C2C2: 4. Lachnospiraceae bacterium NK4A144. Figure discloses SEQ ID NOS 1231-1232, respectively, in order of appearance.
Figure 26:
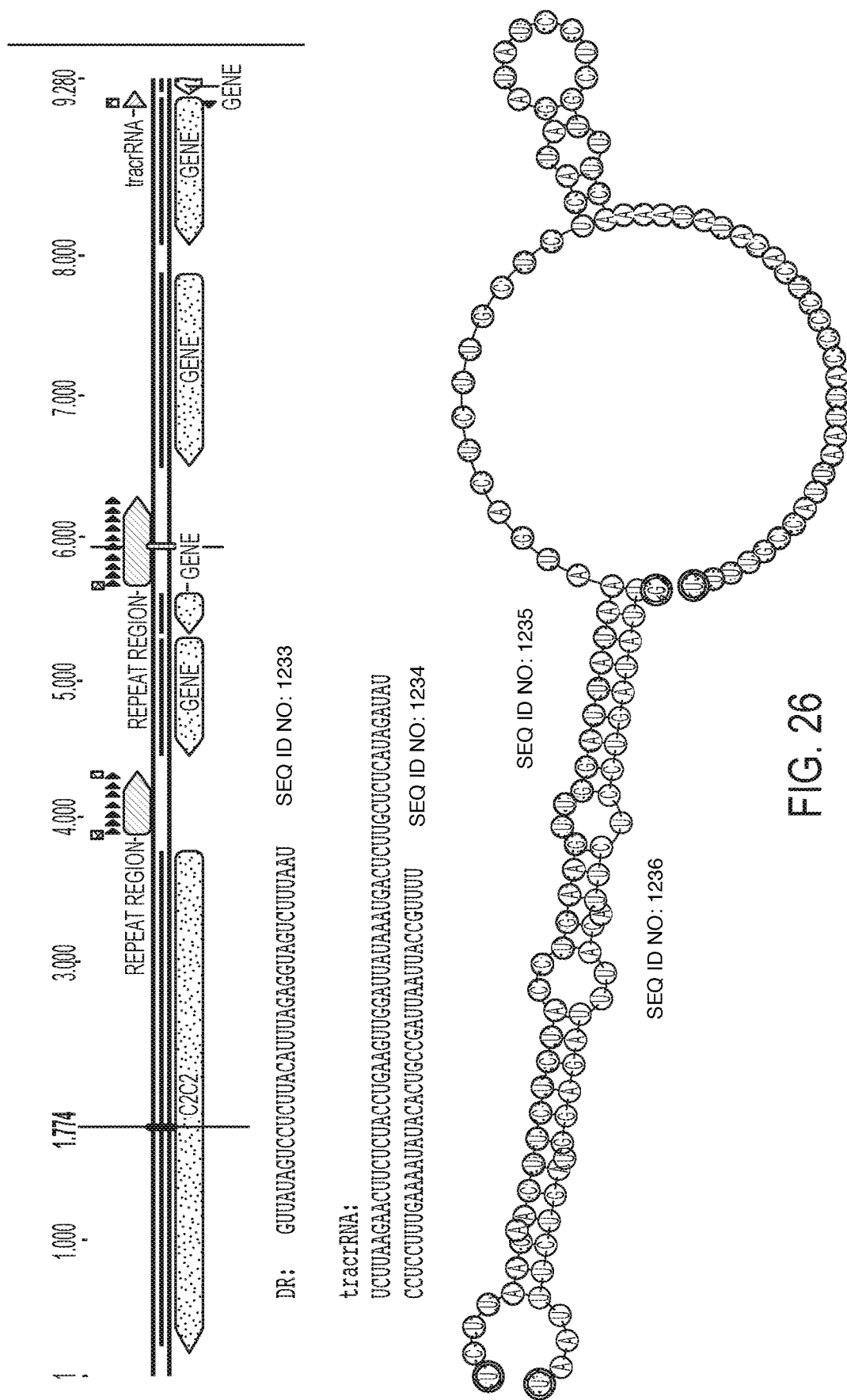
FIG. 26 depicts C2C2: 5. *Carnobacterium gallinarum* DSM 4847. Figure discloses SEQ ID NOS 1233-1236, respectively, in order of appearance.
Figures 1, 27:
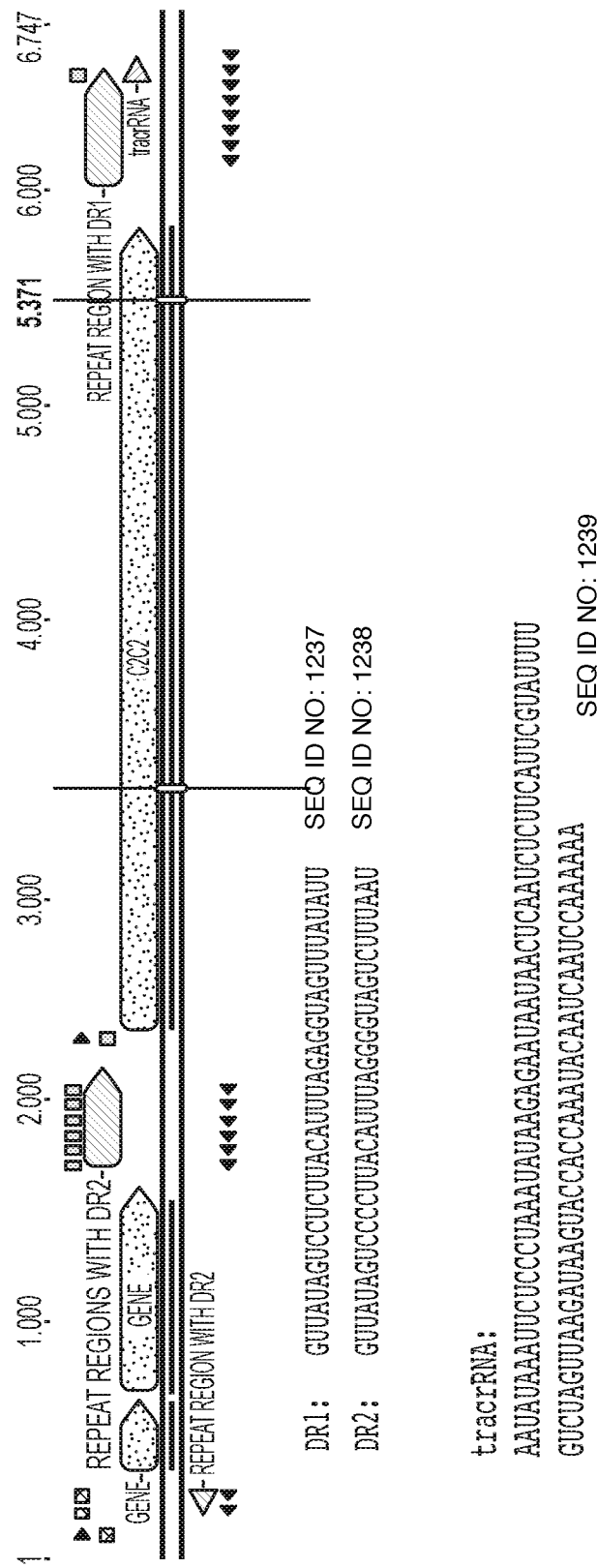
Figures 2, 27:
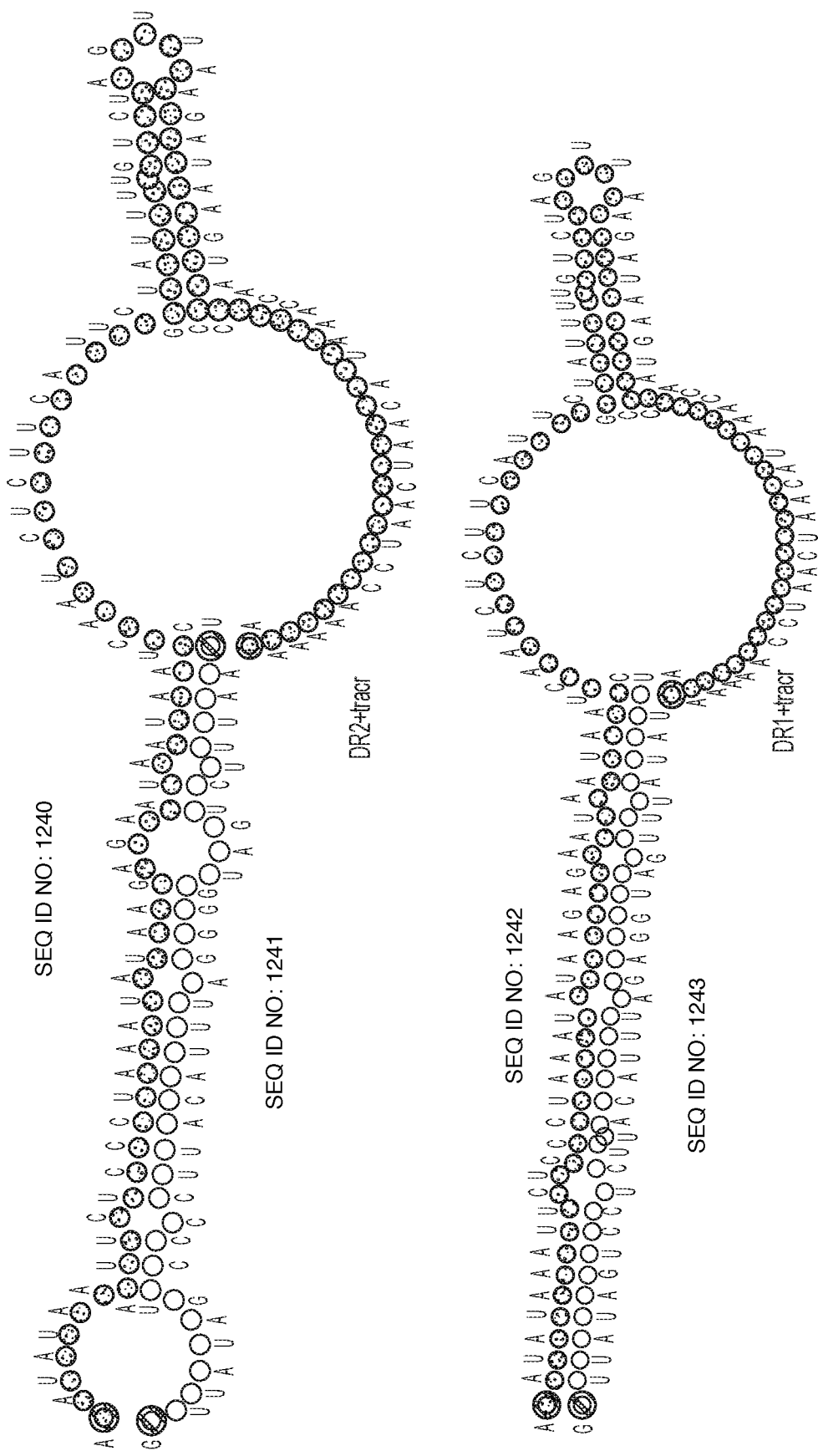
Figure 28:
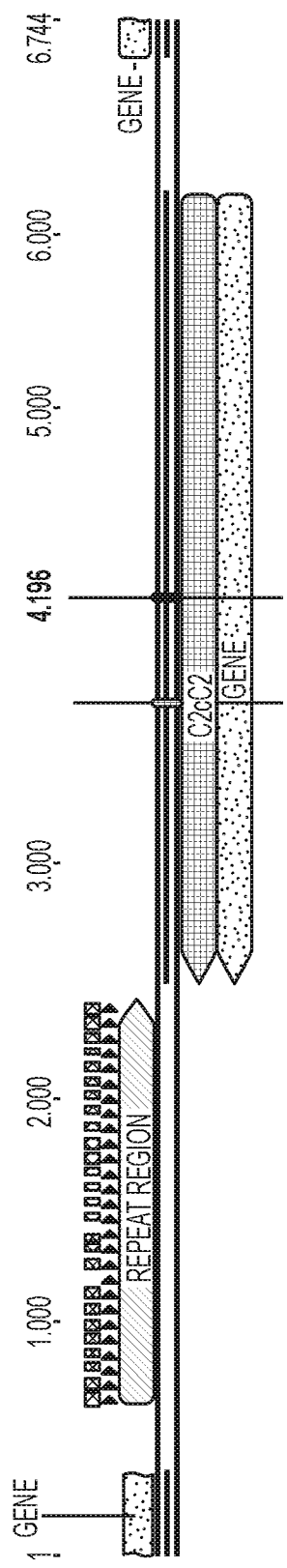
FIG. 28 depicts C2C2: 7. *Paludibacter propionicigenes* WB4. Figure discloses SEQ ID NO: 1244.
Figure 29:
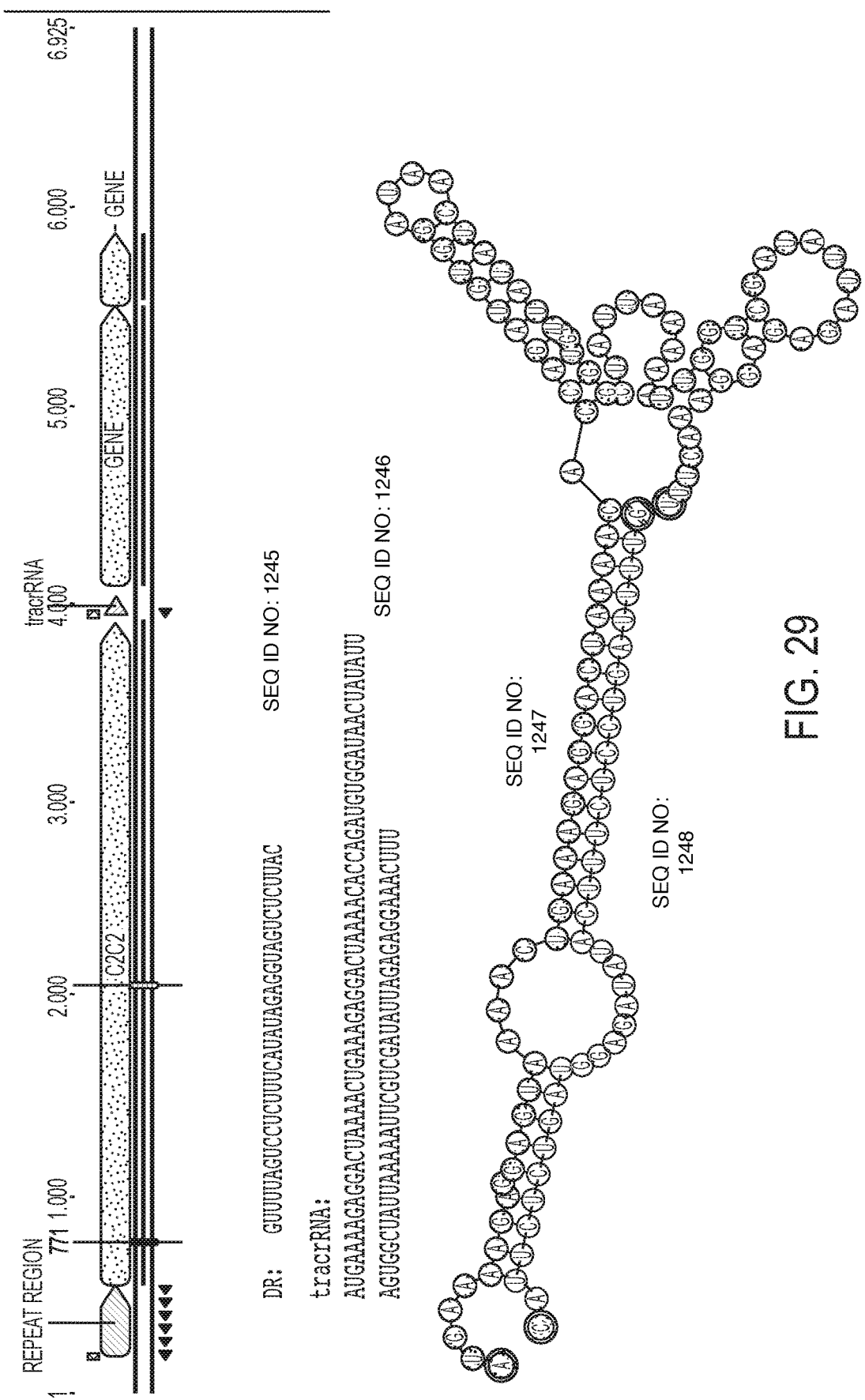
FIG. 29 depicts C2C2: 8. *Listeria seeligeri* serovar 1/2b. Figure discloses SEQ ID NOS 1245-1248, respectively, in order of appearance.
Figure 30:
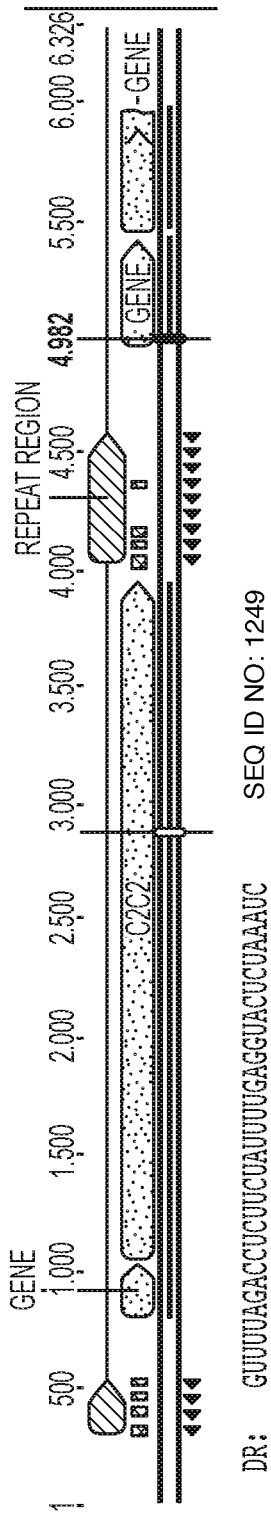
FIG. 30 depicts C2C2: 9. *Listeria weihenstephanensis* FSL R9-0317. Figure discloses SEQ ID NO: 1249.
Figures 1, 31:
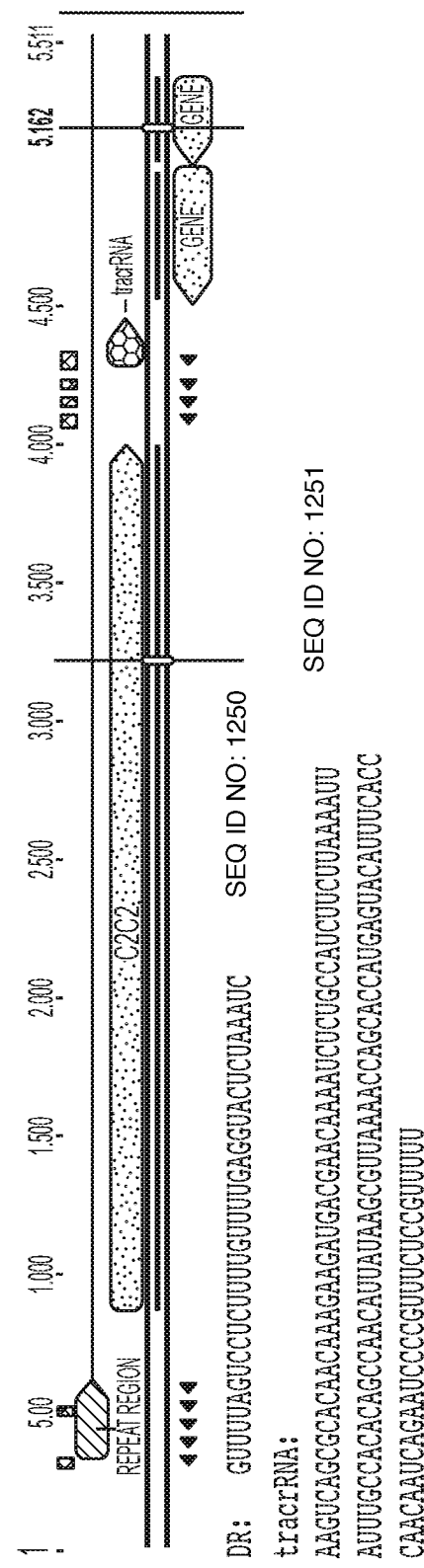
Figures 2, 31:
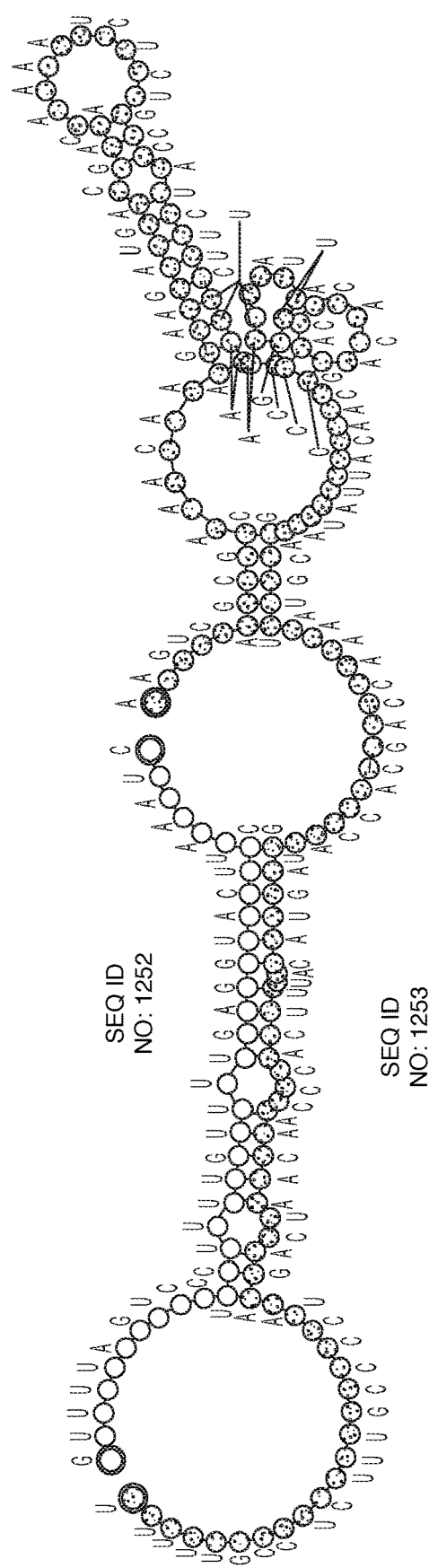
Figures 2, 33:
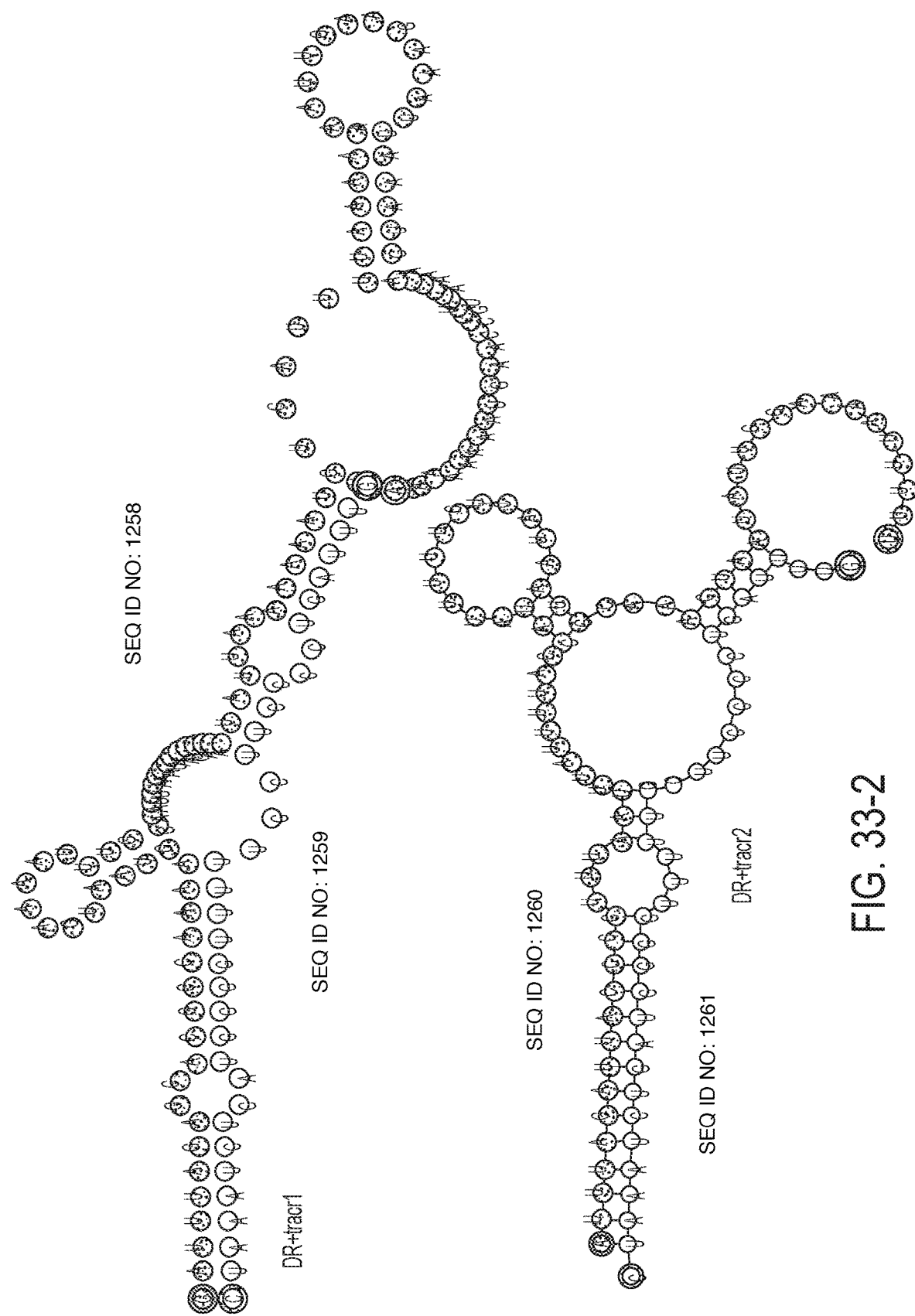
Figure 34:
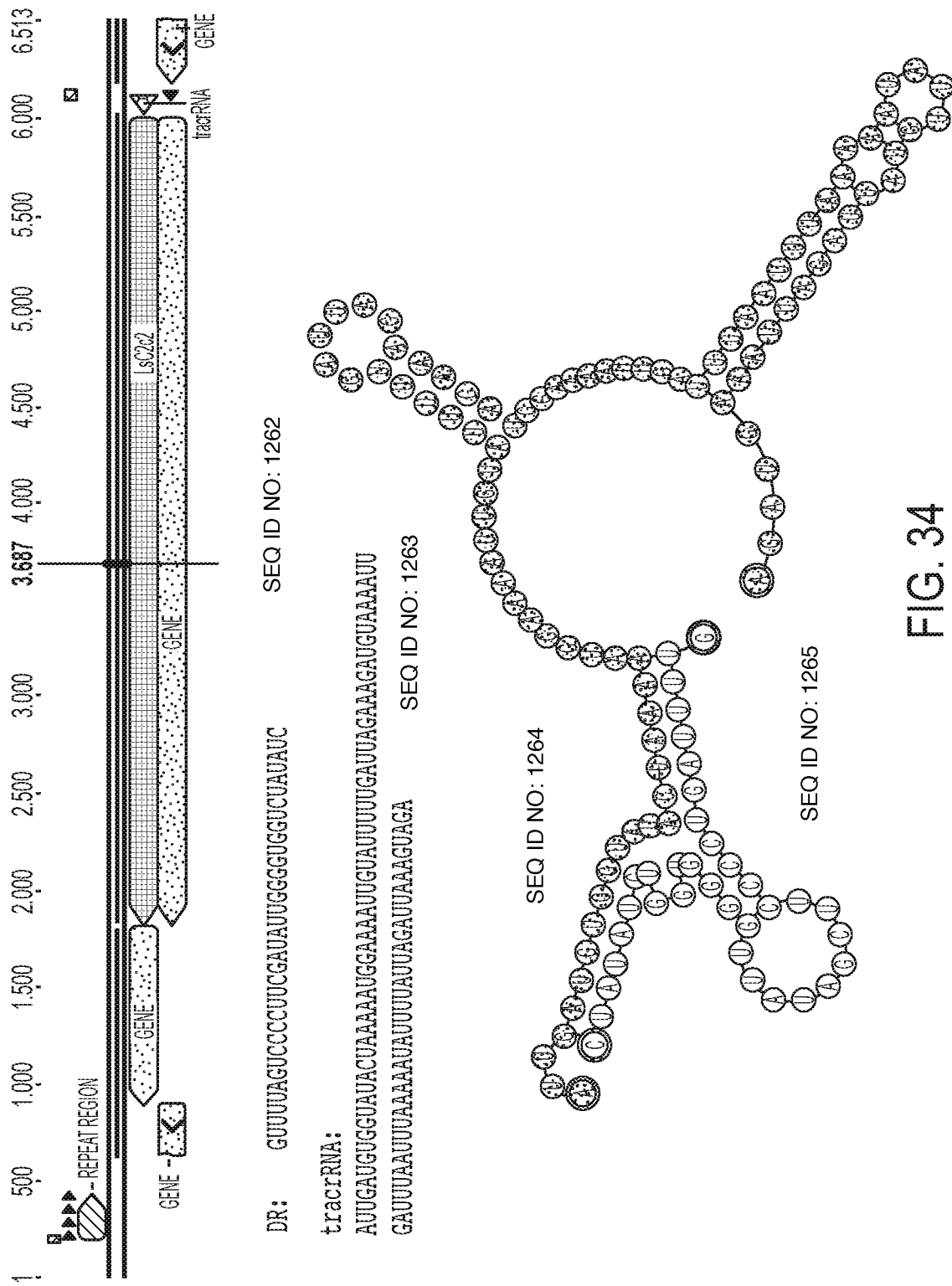
FIG. 34 depicts C2C2: 14. *Leptotrichia shahii* DSM 19757. Figure discloses SEQ ID NOS 1262-1265, respectively, in order of appearance.
Figure 35:
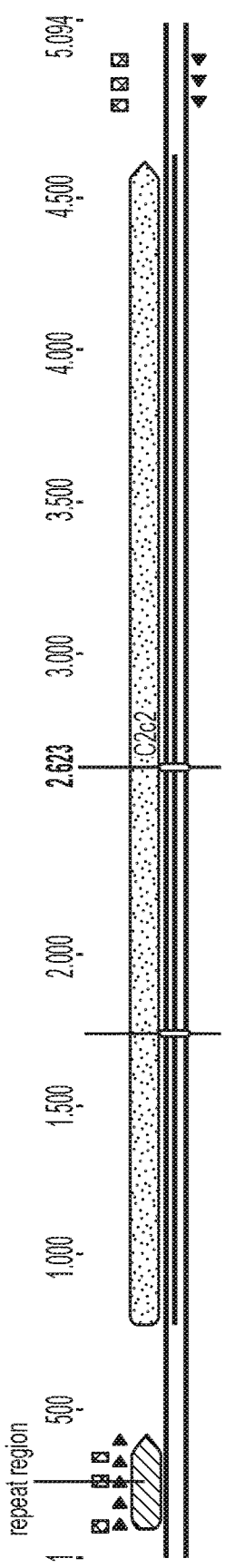
FIG. 35 depicts C2C2: 15. *Rhodobacter capsulatus* SB 1003. Figure discloses SEQ ID NOS 1266-1267, respectively, in order of appearance.
Figure 36:
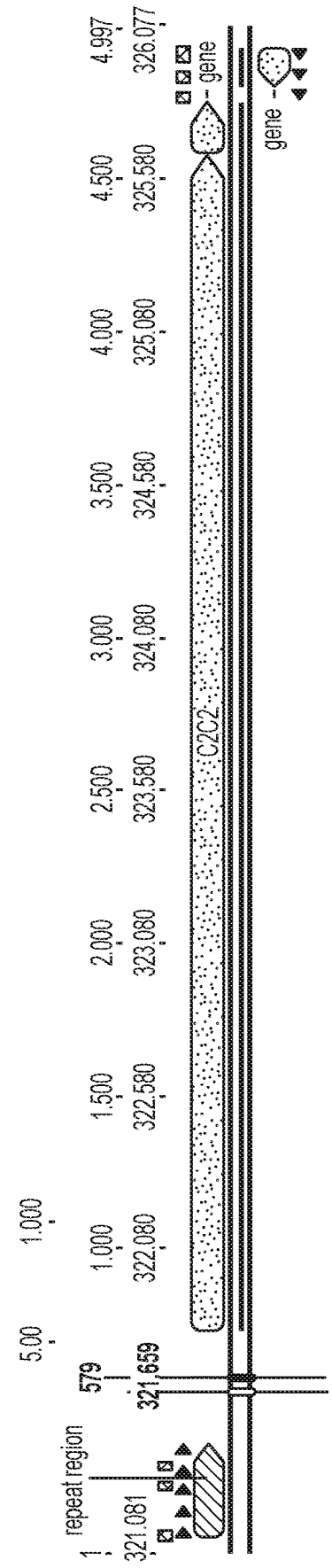
FIG. 36 depicts C2C2: 16. *Rhodobacter capsulatus* R121. Figure discloses SEQ ID NOS 1268-1269, respectively, in order of appearance.
Figure 37:
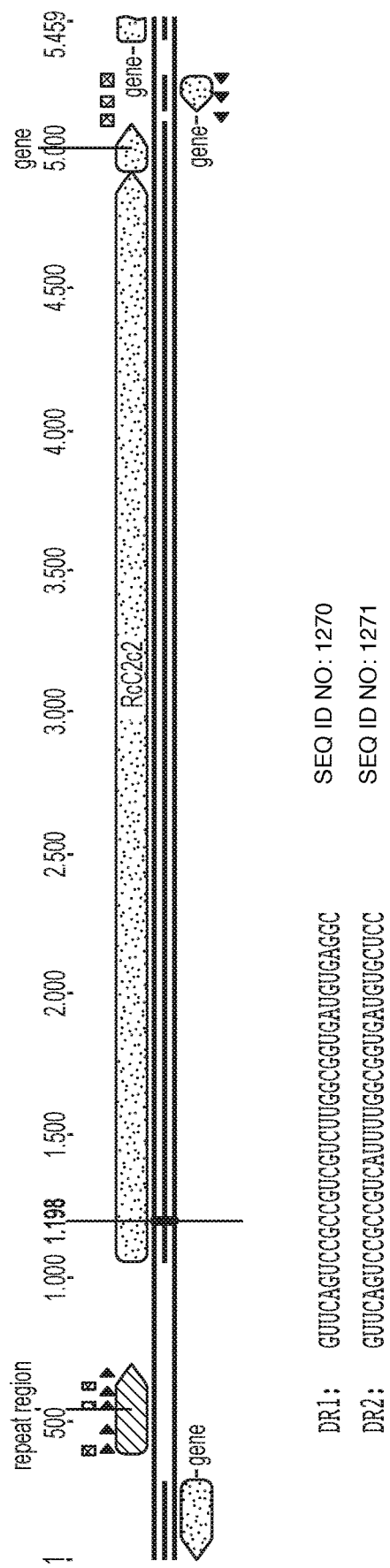
FIG. 37 depicts C2C2: 17. *Rhodobacter capsulatus* DE442. Figure discloses SEQ ID NOS 1270-1271, respectively, in order of appearance.
Figure 38:
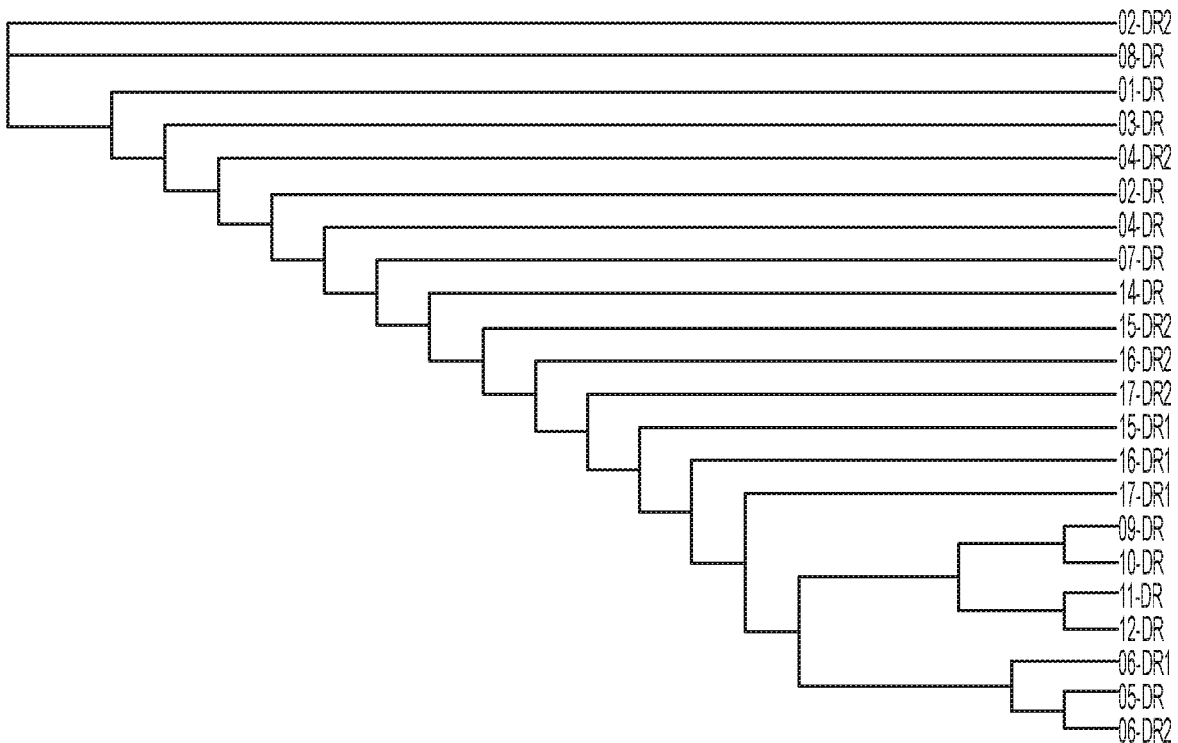
FIG. 38 depicts a tree of DRs
Figure 39:
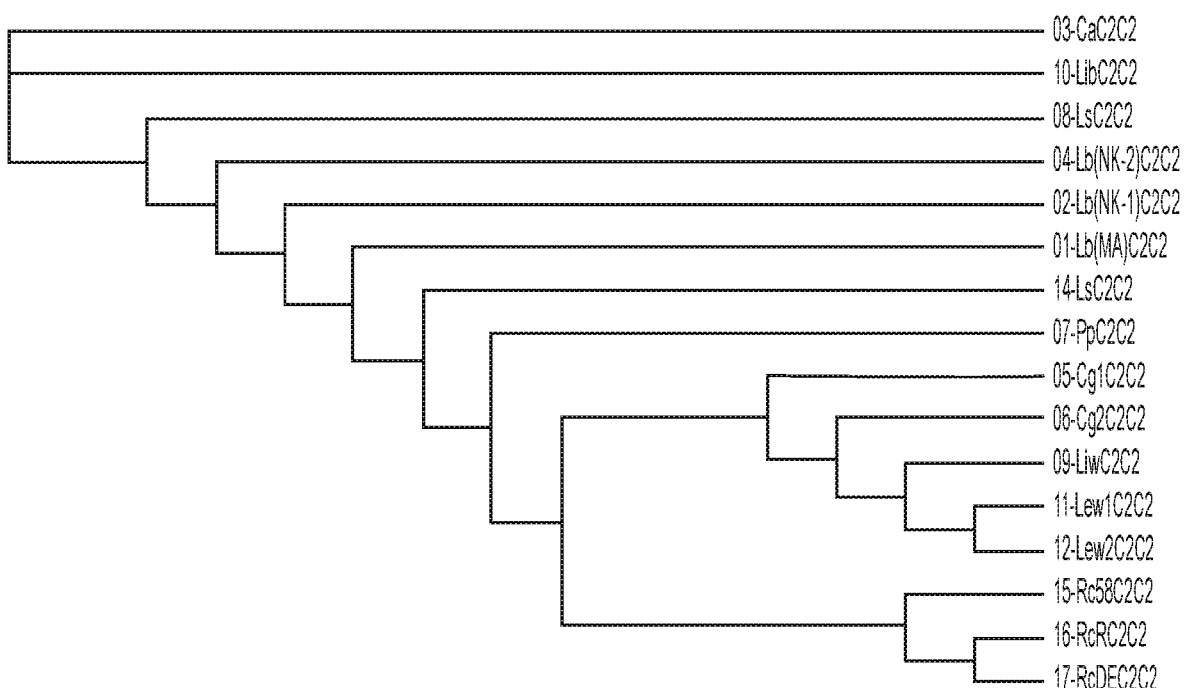
FIG. 39 depicts a tree of C2c2s
Figures 1, 41M:
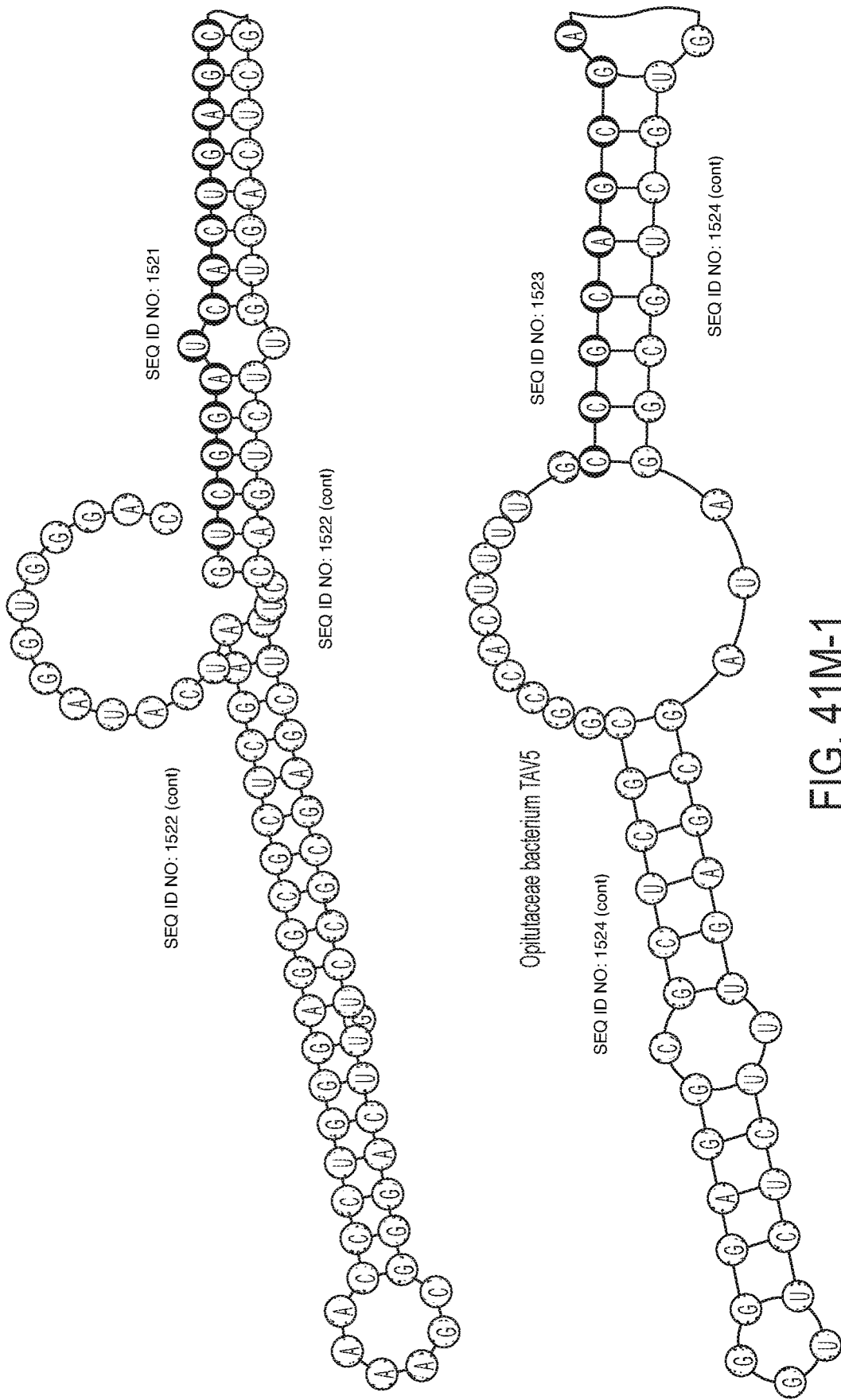
Figures 1, 41M:
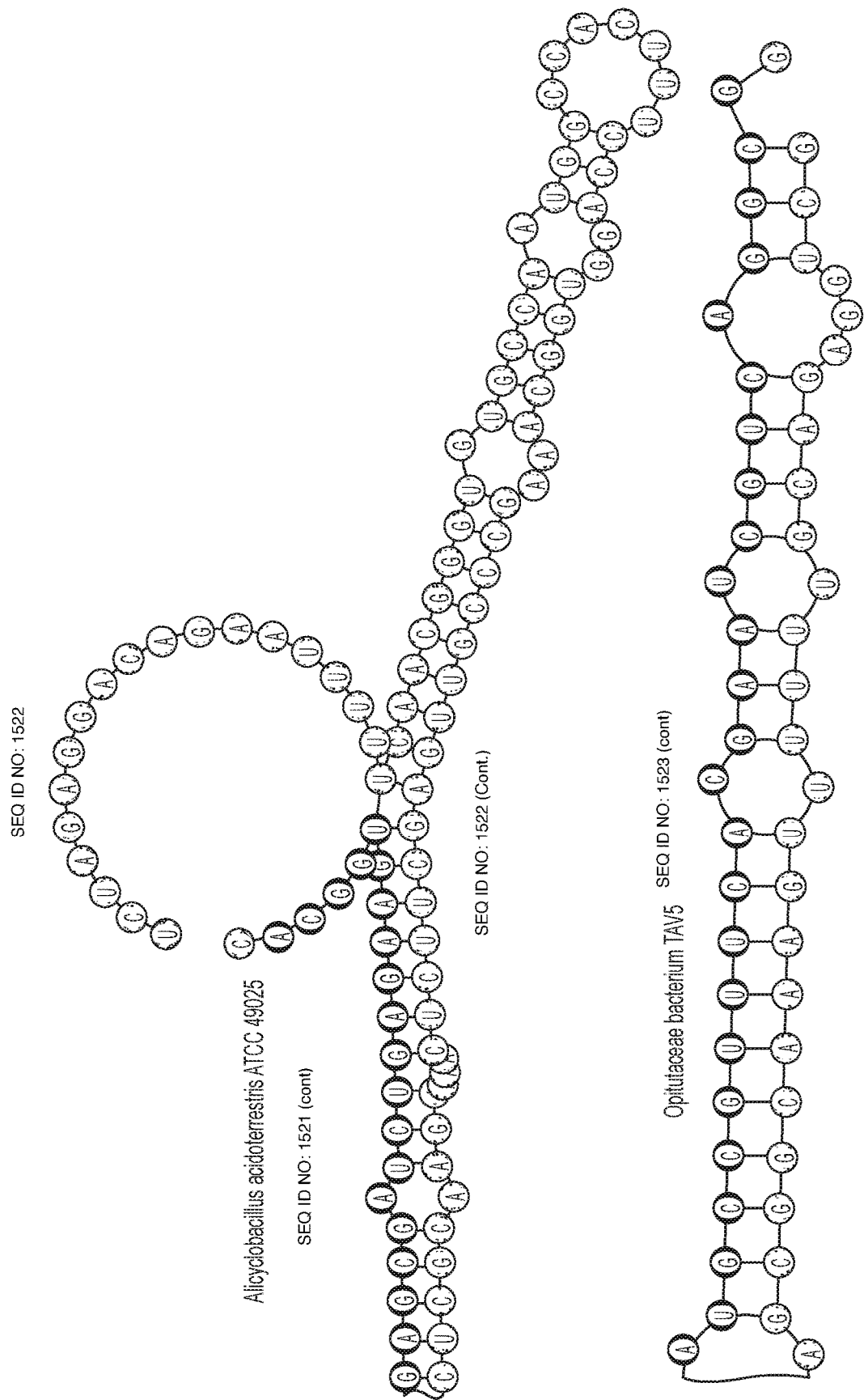
Figures 2, 41M:
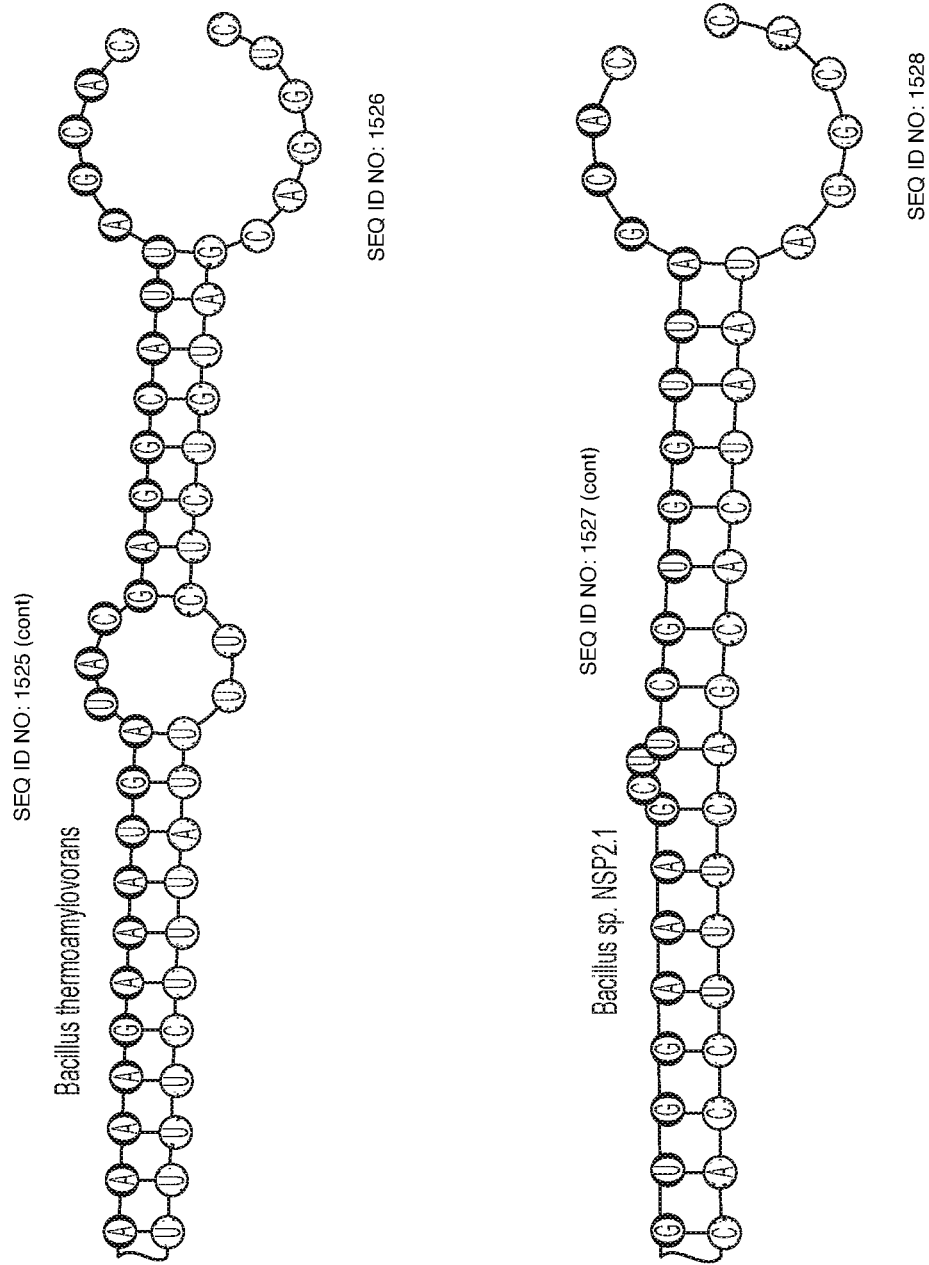

Database search strategy for detection of candidate novel Class 2 CRISPR-Cas loci. Applicants implemented a straightforward computational approach to identify candidate novel Class 2 CRISPR-Cas systems (FIG. 7. Pipeline). Because the vast majority of the CRISPR-Cas loci encompass a cas1 gene (Makarova, 2011; Makarova, 2015) and the Cas1 sequence is the most highly conserved one among all Cas proteins (Takeuchi, 2012), Applicants reasoned that cas1 is the best possible anchor to identify candidate new loci using translating PSI-BLAST search with Cas1 profiles. After detecting all contigs encoding Cas1 by searching the WGS (whole genome shotgun) and NT (nucleotide) databases at the NCBI, the protein-coding genes were predicted using GenemarkS within the 20 KB regions upstream and downstream of the cas1 gene. These predicted genes were annotated using the NCBI Conserved Domain Database (CDD) and Cas protein-specific profiles (Makarova et al., 2015, Nat Rev Microbiol. 2015, doi: 10.1038/nrmicro3569), and CRISPR arrays were predicted using the PILER-CR program. This procedure provided for assignment of the detected CRISPR-Cas loci to the known subtypes. Partial and/or unclassified candidate CRISPR-Cas loci containing large (>500 aa) proteins were selected as candidates for novel Class 2 systems given the characteristic presence of such large single-subunit effector proteins in Types II and V systems (Cas9 and Cpf1, respectively). All 63 candidate loci detected using these criteria (listed in the Table set forth in FIG. 40A-40D) were analyzed on a case by case basis using PSI-BLAST and HHpred. The protein sequences encoded in the candidate loci were further used as queries to search metagenomic databases for additional homologs, and long contigs detected in these searches were analyzed as indicated above. This analysis pipeline yielded a total of 53 novel loci (some of the originally identified 63 candidate loci were discarded as spurious whereas several incomplete loci that lacked cas1 were added) with characteristic features of Class 2 CRISPR-Cas systems that could be classified into three distinct groups of loci based on the nature of the predicted effector proteins (see FIGS. 8A and 8B;

FIGS. 9, 14 and 15; and FIGS. 41A-41B, 42A-42B, and 43A-43B). Although bacteriophages infecting bacteria that harbor the newly discovered class 2 CRISPR-Cas systems are virtually unknown, for each of these systems, we detected spacers that matched phages or predicted prophages.

Using the computational strategy, the Applicants realised three new Class 2 CRISPR-Cas systems, namely C2c1 and C2c3, which are classified as subtypes of the previously described putative type V, and C2c2, which the Applicants assign to a new putative type VI on the strength of the presence of a novel predicted effector protein. The Applicants present multiple lines of evidence that these loci encode functional CRISPR-Cas systems. On the comparative genomic side, we identified phage-specific spacers for each of the three putative novel systems and also showed that the sets of spacers are completely different in closely related bacterial genomes suggestive of active, functioning immunity. Many of these new systems occur in bacterial genomes that encompass no other CRISPR-Cas loci, suggesting that type V and type VI systems can function autonomously. Furthermore, even when other CRISPR-Cas systems were identified in the same genomes, the associated repeat structures were clearly distinct from those in types V and VI, suggestive of independent functionality.

Putative type V-B system. The first group of candidate loci, provisionally denoted C2c1 (Class 2 candidate 1), is represented in bacterial genomes from four major taxa, including Bacilli, Verrucomicrobia, alpha-proteobacteria and delta-proteobacteria (FIG. 8A-8B "Organization of complete loci of Class 2 systems"; FIG. 41A-41B). All C2c1 loci encode a Cas1-Cas4 fusion, Cas2, and the large protein that Applicants denote C2c1p, and typically, are adjacent to a CRISPR array (FIG. 9, C2c1 neighborhoods; FIG. 41A-41B). In the phylogenetic tree of Cas1, the respective Cas1 proteins cluster with Type I-U system (FIGS. 10A and 10B, FIG. 10C-1-W, Cas1 tree), the only one in which the Cas1-Cas4 fusion is found. The lengths of the C2c1p proteins identified herein range from about 1100 to about 1500 amino acids, for example may consist of approximately 1200 amino acids, and HHpred search detected significant similarity between the C-terminal portion of the C2c1p proteins and a subset of TnpB proteins encoded in transposons of the IS605 family (FIGS. 13A-1-13A-2 and 13C-1-13C-2). In contrast, no significant similarity was detected between C2c1p and Cas9 or Cpf1 that are similar to other groups of TnpB proteins (Chylinski, 2014) (Makarova, 2015; Makarova, 2015). Thus, the domain architecture of C2c1p is similar to that of Cpf1 and distinct from that of Cas9 (FIG. 13A-1-13A-2) although all three Cas proteins seem to have evolved from the TnpB family (FIG. 11 "Domain organization of class 2 families"; FIG. 13A-1-13A-2). The N-terminal region of C2c1p shows no significant similarity to other proteins. Secondary structure prediction indicates that this region adopts mostly alpha-helical conformation. The two segments of similarity with TnpB encompass the three catalytic motifs of the RuvC-like nuclease, with the diagnostic D.E.D signature of catalytic amino acid residues (Aravind et al., 2000, Nucleic Acids Res, vol. 28, 3417-3432) (FIG. 12-1-12-2, "TnpB homology regions in Class 2 proteins"); the region corresponding to the bridge helix (also known as arginine-rich cluster) that in Cas9 protein is involved in crRNA-binding; and a small region that appears to be the counterpart to the Zn finger of TnpB (however, the Zn-binding cysteine residues are missing in the majority of C2c1 proteins indicating that such proteins do not bind zinc; moreover, C2c1 contain multiple insertions and deletions in this region suggestive of functional divergence (FIG. 13A-1-13A-2, FIG. 13D-1-13H-2, FIG. 13I-1-13I-4). The conservation of the catalytic residues (FIG. 13A-1-13A-2) strongly suggests that the RuvC homology domains of all these proteins are active nucleases. The N-terminal regions of C2c1 show no significant similarity to any known proteins. Secondary structure predictions indicate that the N-terminal regions of C2c1 proteins adopt a mixed/conformation (FIG. 13D-1-13H-2, FIG. 13I-1-13I-4). The similarity of the domain architectures of C2c1p and Cpf1 suggests that the C2c1 loci are best classified as Subtype V-B in which case the Cpf1-encoding loci become Subtype V-A.

Despite similarity of cas1 genes associated with this system, the CRISPR repeats in the respective arrays are highly heterogeneous although all of them are 36-37 bp long and can be classified as unstructured (folding energy, ΔG, is −0.5-4.5 kcal/mole whereas highly palindromic CRISPR have ΔG below −7 kcal/mole). According to the CRISPR-map (Lange, 2013) classification scheme, several of the Subtype V-B repeats share some sequence or structural similarity with Type II repeats (FIG. 41A-41M-2). However, most of the repeats could not be classified into the known sequence or structure families and were variously assigned to 4 of the 6 superclasses (FIG. 41A-41M-2).

Considering the possibility that the putative Subtype V-B CRISPR-Cas systems are mechanistically analogous to Type II systems, Applicants attempted to identify the tracrRNA in the respective genomic loci Comparison of the spacers from the Type V-B CRISPR arrays to the non-redundant nucleotide sequence database identified several matches to various bacterial genomes. In particular, one of the spacers from *Alicyclobacillus acidoterrestris* and one of the spacers from *Brevibacillus agri* matched uncharacterized genes within predicted prophages integrated into the respective bacterial genomes (FIG. 41A-41L).

Figure 42M:
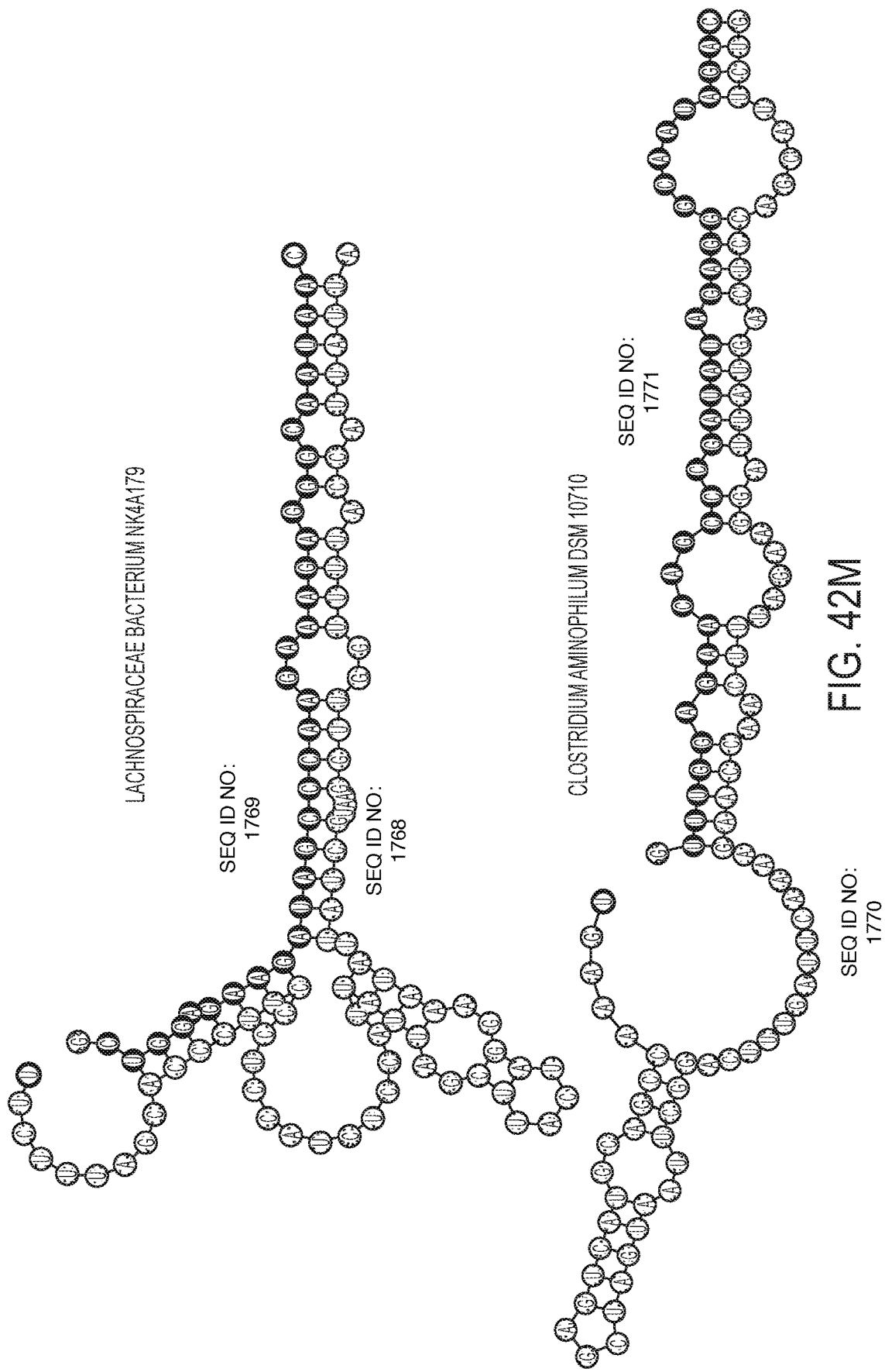
Figures 1, 42N:
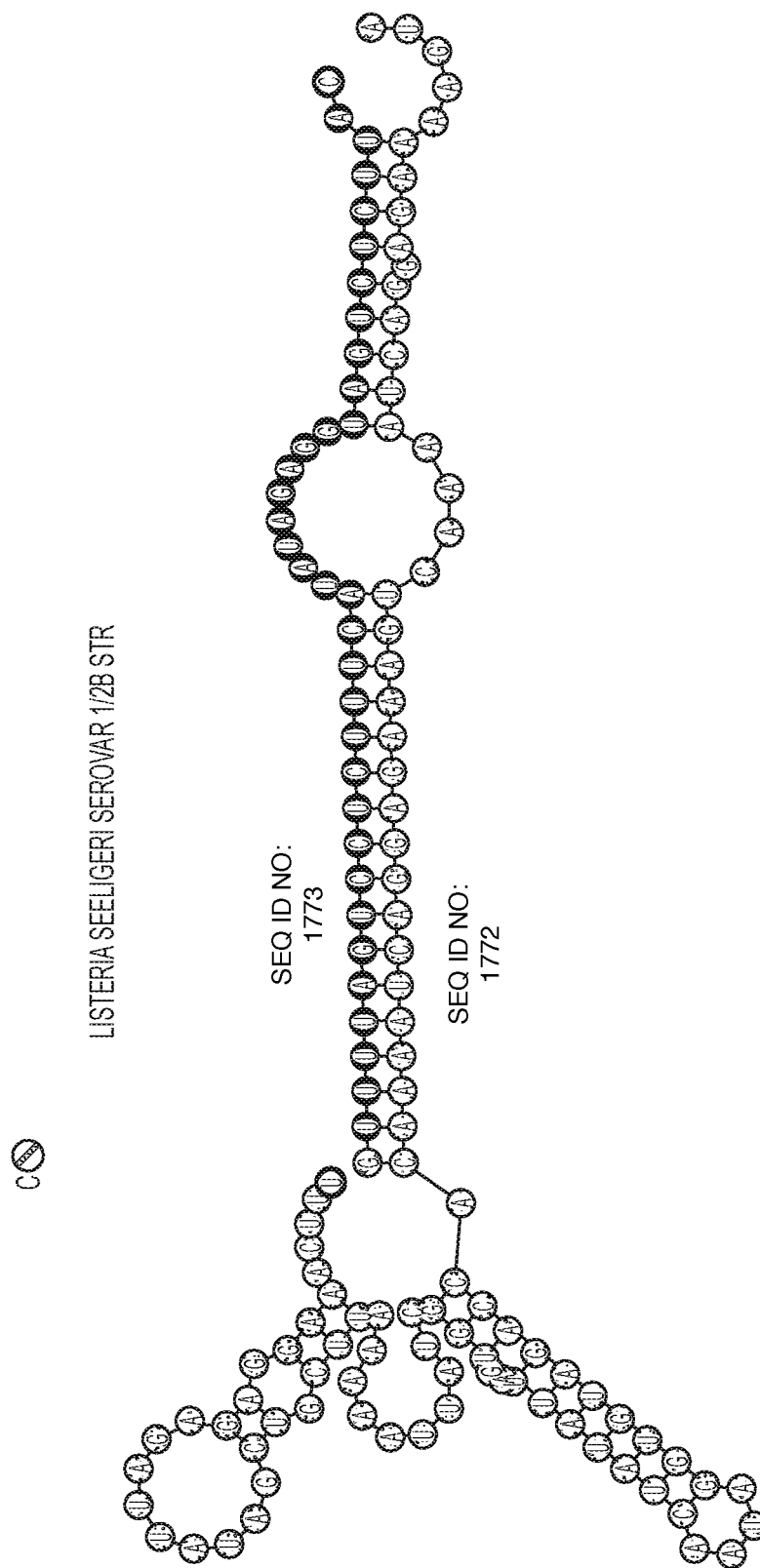
Figures 2, 42N:
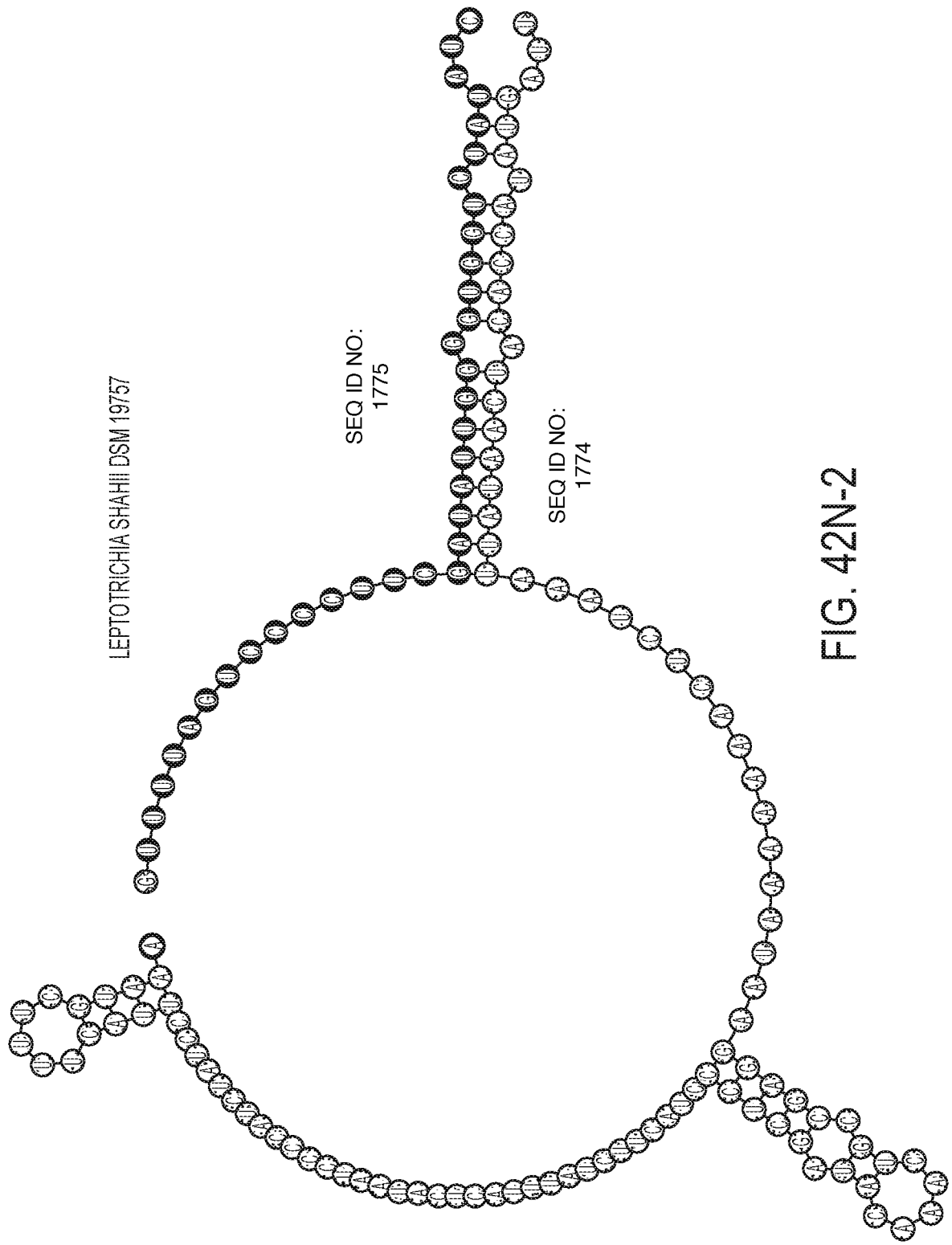

Putative type VI systems. The second group of candidate CRISPR-Cas loci, denoted C2c2 (Class 2 candidate 2), was identified in genomes from 5 major bacterial taxa, including alpha-proteobacteria, Bacilli, Clostridia, Fusobacteria and Bacteroidetes (FIG. 8A-8B "Organization of complete loci of Class 2 systems"; FIG. 42A-42B). A number of C2c2 loci encompass cas1 and cas2 genes, along with a large protein (C2c2p) that shows no sequence similarity to C2c1, Cpf1, or Cas9, and a CRISPR array; however, unlike C2c1, C2c2p is often encoded next to a CRISPR array but not cas1-cas2 (FIG. 15, C2c2 neighborhoods; FIG. 42A-42B). Although under our computational strategy, the originally identified C2c2 loci encompassed the cas1 and cas2 genes, subsequent searches showed that the majority of such loci may consist only of the c2c2 gene and a CRISPR array. Such apparently incomplete loci could either encode defective CRISPR-Cas systems or might function with the adaptation module encoded elsewhere in the genome, as has been observed for some type III systems (Majumdar et al., 2015, RNA, vol. 21, 1147-1158). In the phylogenetic tree of Cas1, the Cas1 proteins from the C2c2 loci are distributed among two clades. The first clade includes Cas1 from Clostridia and is located within the Type II subtree along with a small Type III-A branch (FIGS. 10A and 10B, FIG. 10C-1-10W, Cas1 tree). The second clade consists of Cas1 proteins from C2c2 loci of Leptotrichia and is lodged inside a mixed branch that mostly contains Cas1 proteins from Type III-A CRISPR-Cas systems. Database searches using HHpred and PSI-BLAST detected no sequence similarity between C2c2p and other proteins. However, inspection of multiple alignments of C2c2p protein sequences led to the identification of two strictly conserved RxxxxH motifs that are characteristic of HEPN (Higher Eukaryotes and Prokaryotes Nucleotide-binding) domains (Anantharaman et al., 2013, Biol Direct, vol. 8, 15; Grynberg et al., 2003, Trends in biochemical sciences, vol. 28, 224-226) (FIG. 11 and FIG. 13B, FIG. 13J-1-13N-4). Secondary structure predictions indicates that these motifs are located within structural contexts compatible with the HEPN domain structure as is the overall secondary structure prediction for the respective portions of C2c2p. The HEPN domains are small (~150 aa) alpha helical domains with diverse sequences but highly conserved catalytic motifs that have been shown or predicted to possess RNAse activity and are often associated with various defense systems (Anantharaman, 2013) (FIGS. 13B and 16-1-16-6, HEPN RxxxxH motif in C2c2 family). The sequences of HEPN domains show little conservation except for the catalytic RxxxxH motif. While the sequences of the two putative HEPN domains of C2c2 show little similarity to other HEPN domains except for the catalytic RxxxxH motifs, the domain identity is strongly supported by secondary structure predictions that indicate that each motif is located within compatible structural contexts (FIG. 13B, FIG. 13J-1-13N-4). Furthermore, the predicted secondary structure of the entire sequence for each putative domain is also consistent with the HEPN fold (FIG. 13J-1-13N-4). Thus, it appears likely that C2c2p contains two active HEPN domains. The HEPN domain is not new to CRISPR-Cas systems as it is often associated with the CARF (CRISPR-Associated Rossmann Fold) domain in Csm6 and Csx1 proteins that are present in many Type III CRISPR-Cas systems (Makarova, 2014). These proteins do not belong to either the adaptation modules or effector complexes but are thought to perform some accessory, still uncharacterized functions in cognate CRISPR, more particularly they appear to be components of the associated immunity module that is present in the majority of CRISPR-Cas systems and is implicated in programmed cell death as well as regulatory functions during the CRISPR response (Koonin, 2013; Makarova, 2012; Makarova, 2013). However, C2c2p differs from Csm6 and Csx1 in that this much larger protein is the only common protein encoded in the C2c2 loci, except for Cas1 and Cas2. Thus, it appears likely that C2c2p is the effector of these putative novel CRISPR-Cas systems and the HEPN domains are the catalytic moieties thereof. Outside of the predicted HEPN domains, the C2c2p sequence showed no detectable similarity to other proteins and is predicted to adopt a mixed alpha/beta secondary structure without discernible similarity to any known protein folds (FIG. 13J-1-13N-4).

The CRISPR arrays in the C2c2 loci are highly heterogeneous, with the length of 35 to 39 bp, and unstructured (folding energy of −0.9 to 4.7 kcal/mole). According to CRISPRmap (Lange, 2013), these CRISPR do not belong to any of the established structural classes and are assigned to 3 of the 6 superclasses. Only the CRISPR from *Listeria seeligeri* was assigned to the sequence family 24 that is usually associated with Type II-C systems (FIG. 42A-42L).

Spacer analysis of the C2c2 loci identified one 30 nucleotide region identical to a genomic sequence from *Listeria weihenstephanensis* and two imperfect hits to bacteriophage genomes, in particular, a spacer from *Listeria weihenstephanensis* matched the tail gene of a *Listeria* bacteriophage (FIG. 42A-42L).

Given the unique predicted effector complex of C2c2, these systems seem to qualify as a putative Type VI CRISPR-Cas. Furthermore, taking into account that all experimentally characterized and enzymatically active HEPN domains are RNAses, Type VI systems are likely to act at the level of RNA, such as mRNA.

Putative type V-C systems. The third group of candidate loci includes solely metagenomic sequences and thus could not be assigned to specific taxa. These loci encompass only two protein-coding genes that encode Cas1 and a large protein denoted C2c3 (Class 2 candidate 3) (FIG. 8A "Organization of complete loci of Class 2 systems"; FIG. 14, C2c3 neighbourhoods, FIG. 43A-43B). The C2c3 proteins are in the same size range as Cpf1 and C2c1, and similarly contain a TnpB-homologous domain at their C-termini which, unlike the respective domain of C2c1, showed a limited but significant similarity to Cpf1 (FIGS. 13A-1-13A-2 and 13C-1-13C-2). The TnpB homology regions of C2c3 contain the three catalytic motifs of the RuvC-like nuclease, with the diagnostic D.E.D triad of catalytic amino acid residues (Aravind et al., 2000, supra), the region corresponding to the bridge helix (also known as the arginine-rich cluster), which is involved in crRNA-binding in Cas9, and a small region that appears to be the counterpart to the Zn finger of TnpB (the Zn-binding cysteine residues are conserved in C2c3). The conservation of the catalytic residues strongly suggests that the RuvC homology domains of all these proteins are active nucleases. The N-terminal regions of C2c1 and C2c3 show no significant similarity to each other or any known proteins. Secondary structure predictions indicate that the N-terminal regions of C2c3 proteins adopt a mixed/O conformation. Thus, the overall domain architectures of C2c1 and C2c3, and in particular the organization of the RuvC domain, are similar to that of Cpf1 but distinct from that of Cas9. This suggests that the C2c1 and C2c3 loci are best classified as subtypes V-B (see above) and V-C, respectively, with Cpf1-encoding loci now designated subtype V-A.

Among the c2c3 loci, only one contains a CRISPR array with unusually short, 17-18 nt spacers. The repeats in this array are 25 bp long and appear to be unstructured with folding energy of −1.6 kcal/mol (FIG. 43A-43F).

Spacers from the only C2c3 contig containing a CRISPR array are too short to produce statistically significant hits. Nevertheless, several matches to sequences from predicted prophages were identified (FIG. 43A-43F).

The subsets of the TnpB proteins with significant similarity to the one known (Cas9) and three herein disclosed putative Class 2 effectors (Cpf1, C2c1 and C2c3) did not overlap (FIGS. 13A-1-13A-2 and 13C-1-13C-2). Although the sequence divergence among the TnpB-like domains is too high to allow reliable phylogenetic analysis, these findings suggest that the four currently identified large effector proteins of Class 2, Cas9, Cpf1, C2c1 and C2c3, have evolved independently from genes of distinct transposable elements.

Figure 45A:
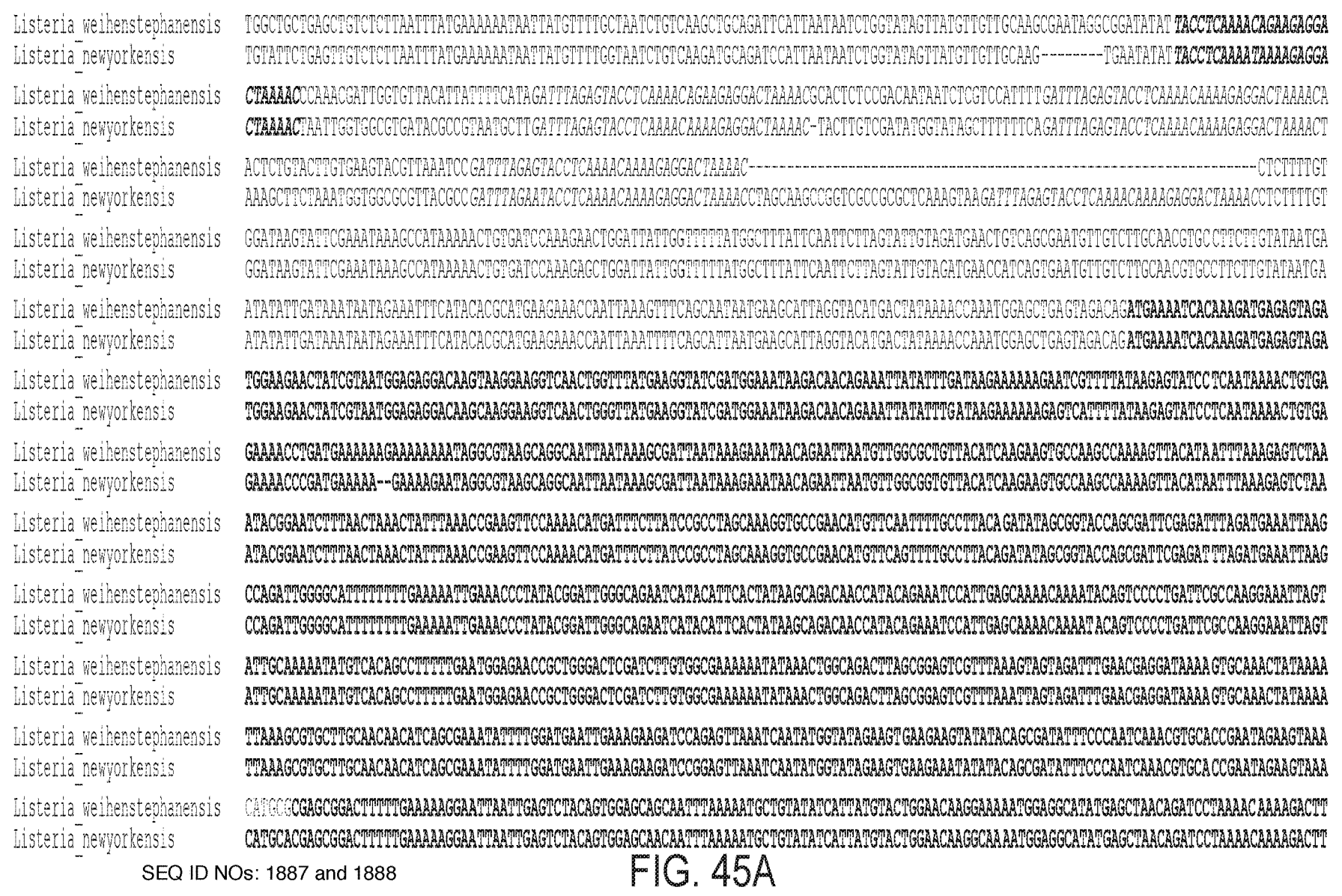
Figure 45B:
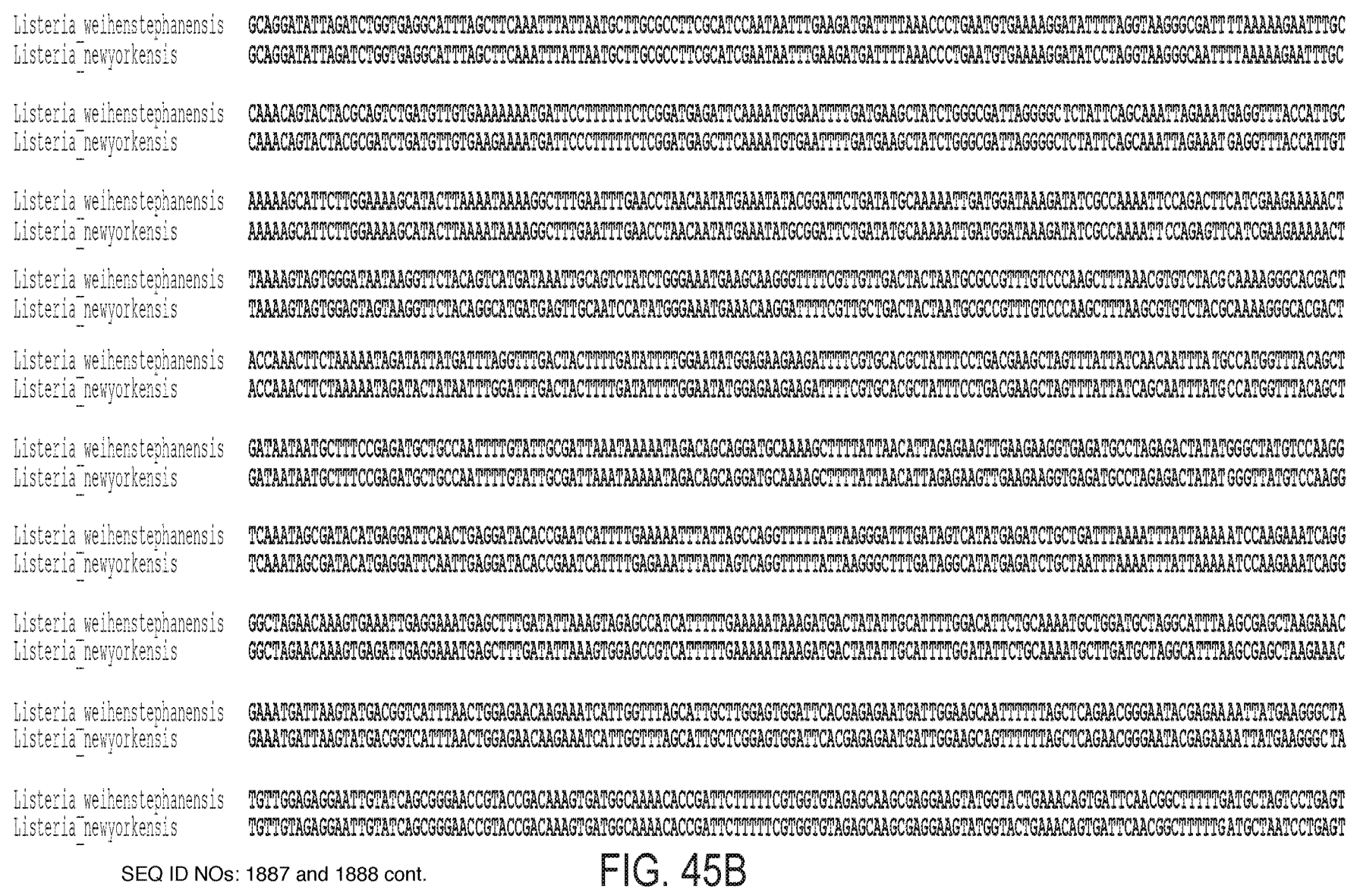
Figure 45C:
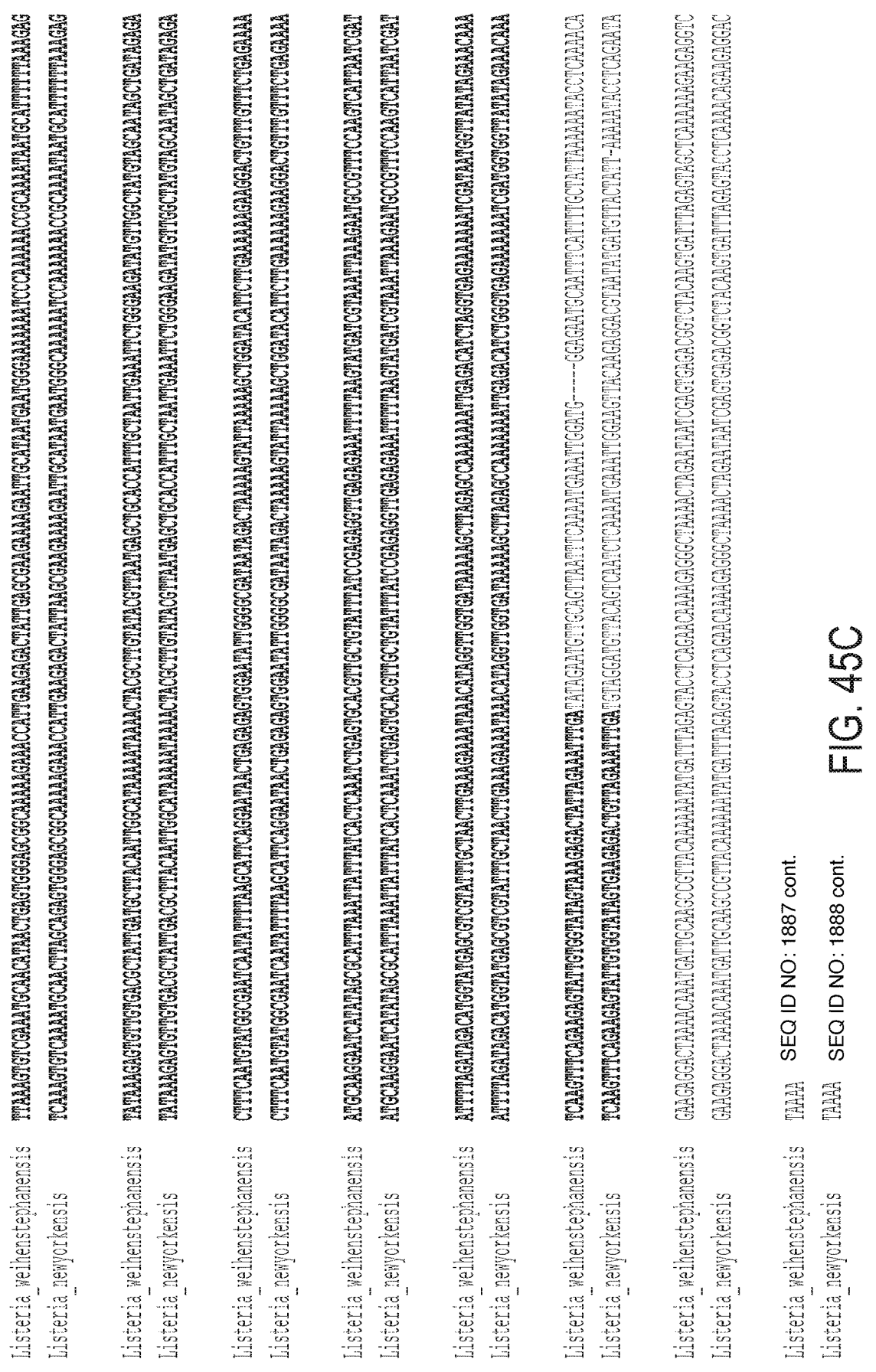

Although the majority of spacers in the new CRISPR-Cas loci described herein were not significantly similar to any available sequences, the existence of spacers matching phage genomes implies that these loci may encode active, functional adaptive immunity systems. The small fraction of phage-specific spacers is typical of CRISPR-Cas systems and is most likely indicative of their dynamic evolution and the small fraction of virus diversity that is represented in the current sequence databases. This interpretation is compatible with the observation that closely related bacterial strains encoding homologous CRISPR-Cas loci typically contain unrelated collections of spacers, as exemplified by the C2c2 loci from *Listeria* weihenstephanensis and *Listeria* newyorkensis (FIG. 45A-45C).

Applicants applied a simple, straightforward computational strategy to predict new Class 2 CRISPR-cas systems. The previously described class 2 systems, namely Type II and the putative Type V, consisted of the cas1 and cas2 genes (and in some cases also cas4) comprising the adaptation module and a single large protein that comprises the effector module. Therefore, Applicants surmised that any genomic locus containing cas1 and a large protein could be a potential candidate for a novel Class 2 system that merits detailed investigation. Such analysis using sensitive methods for protein sequence comparison led to the identification of three strong candidates two of which are distinct subtypes of the previously described putative Type V (subtypes V-B and V-C) whereas the third one qualifies as a new putative Type VI, on the strength of the presence of a novel predicted effector protein. Many of these new systems occur in bacterial genomes that encompass no other CRISPR-Cas loci (FIG. 44A-44E-2) suggesting that Type V and Type VI systems can function autonomously. The herein disclosed candidate loci were validated through functional assays which revealed the expression and processing of the respective CRISPR arrays, yielding mature crRNAs, identification of putative tracrRNA (where present), demonstration of interference when expressed in *E. coli*, determination of the protospacer adjacent motif (PAM), and interrogation of the minimal components necessary for lysate cleavage.

Type V systems encode predicted effector proteins that resemble Cas9 in their overall domain architecture, but in contrast to Cas9, the RuvC-like domains of Cpf1, C2c1 and C2c3 are contiguous in the protein sequence, lacking the inserts characteristic of Cas9, particularly the HNH nuclease domain. The presence of one instead of two nuclease domains indicates that type V effector proteins mechanistically differ from Cas9 in which the HNH and RuvC domains are responsible for the cleavage of the complementary and non-complementary strands of the target DNA, respectively (Chen et al., 2014, The Journal of biological chemistry, vol. 289, 13284-13294; Gasiunas et al., 2012, Proceedings of the National Academy of Sciences of the United States of America, vol. 109, E2579-2586; Jinek et al., 2012, Science, vol. 337, 816-821). The predicted type V effector proteins might form dimers in which the two RuvC-like domains would cleave the opposite strands of the target molecule.

The putative type VI CRISPR-Cas systems seem to rely on a novel effector protein that contains two predicted HEPN domains that, similar to the previously characterized HEPN domains, could possess RNAse activity, suggesting that type VI systems might target and cleave mRNA. Previously, mRNA targeting has been reported for certain type III CRISPR-Cas systems (Hale et al., 2014, Genes Dev, vol. 28, 2432-2443; Hale et al., 2009, Cell, vol. 139, 945-956; Peng et al., 2015, Nucleic acids research, vol. 43, 406-417). An alternative possibility is that C2c2 is the first DNAse in the HEPN superfamily, perhaps with the two HEPN domains each cleaving one DNA strand. Thus, it might be possible to develop C2c1 and C2c2 into genome editing tools with different classes of targets.

To validate the functionality of these Class2 CRISPR-Cas systems, the Applicants showed that two C2c1 CRISPR arrays are expressed, processed into mature crRNAs, and capable of interference when expressed in E. coli. These experiments revealed several characteristics of the C2c1 locus including: (i) a 5' processed DR on the crRNA, (ii) a 5' PAM, and (iii) the presence of a short RNA with repeat-anti-repeat homology to the processed 5' DR, i.e., a putative tracrRNA. The discovery of a 5' processed DR and 5' PAM supports the scenario in which C2c1 is derived from Class 1 systems because these systems show evidence of 5' repeat processing (type I and III) and a 5' PAM (type I) (Mojica et al., 2009, Microbiology, vol. 155, 733-740; Makarova et al., 2011, Nat Rev Microbioln vol. 9, 467-477). Notably, the AT-rich PAM identified here for C2c1 is in contrast to the GC-rich PAMs of the other well-characterized Class 2 system (type II). For C2c1 loci experimentally characterized here, the Applicants identified crRNAs that are processed to a length that preserves the binding and co-folding with putative tracrRNAs, suggesting that tracrRNAs may be involved in and possibly required for complex formation. We then used expression of C2c1 in a human cell culture to experimentally test that under those circumstances a tracrRNA was involved in and necessary for the in vitro cleavage of target DNA by the particular C2c1 nuclease tested.

The Applicants also showed that when the C2c2 locus from L. seeligeri is expressed in E. coli, it is processed into crRNAs with a 29-nt 5' DR; similar results were obtained for the C2c2 locus of L. shahii. In this case, the degenerate repeat is at the beginning of the array, rather than at the end, as is typical for most CRISPR arrays, and the array and cas genes are transcribed co-directionally. The Applicants did not detect the putative tracrRNA in the C2c2 RNA-seq data. However, the predicted secondary structure of the 29-nt DR shows a stable hairpin handle which could be potentially important for complex formation with the C2c2 effector protein.

Figure 94:
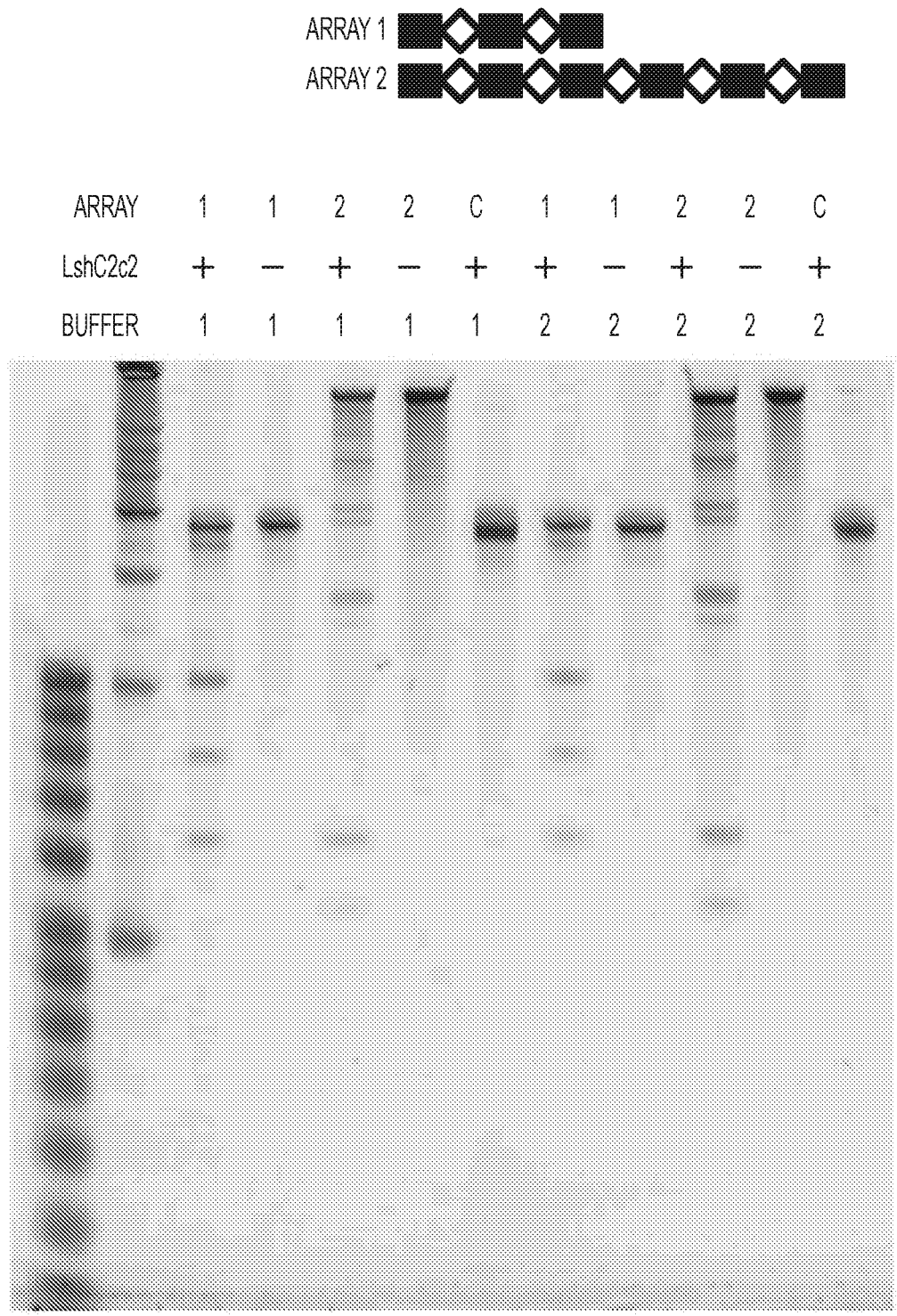
FIG. 94 demonstrates that C2c2 processes its own array Buffer 1: 40 mM Tris-HCl (pH 7.9), 6 mM MgCl2, 70 mM NaCl, 1 mM DTT. Buffer 2: 40 mM Tris-HCl (pH 7.3), 6 mM MgCl2, 70 mM NaCl, 1 mM DTT, Murine RNAse inhibitor. LshC2c2 cleaves both array 1 and array 2 (arrays of different lengths) in both buffers tested. Cleavage is evident by generation of lower bands FIG. 95 demonstrates that HEPN mutants still process the c2c2 CRISPR array.

FIG. 94 demonstrates that processing of the C2c2 array in E. coli requires the C2c2 protein, as evaluated with in vitro transcribed spacer arrays incubated with C2c2 protein.

Figures 1, 13C:
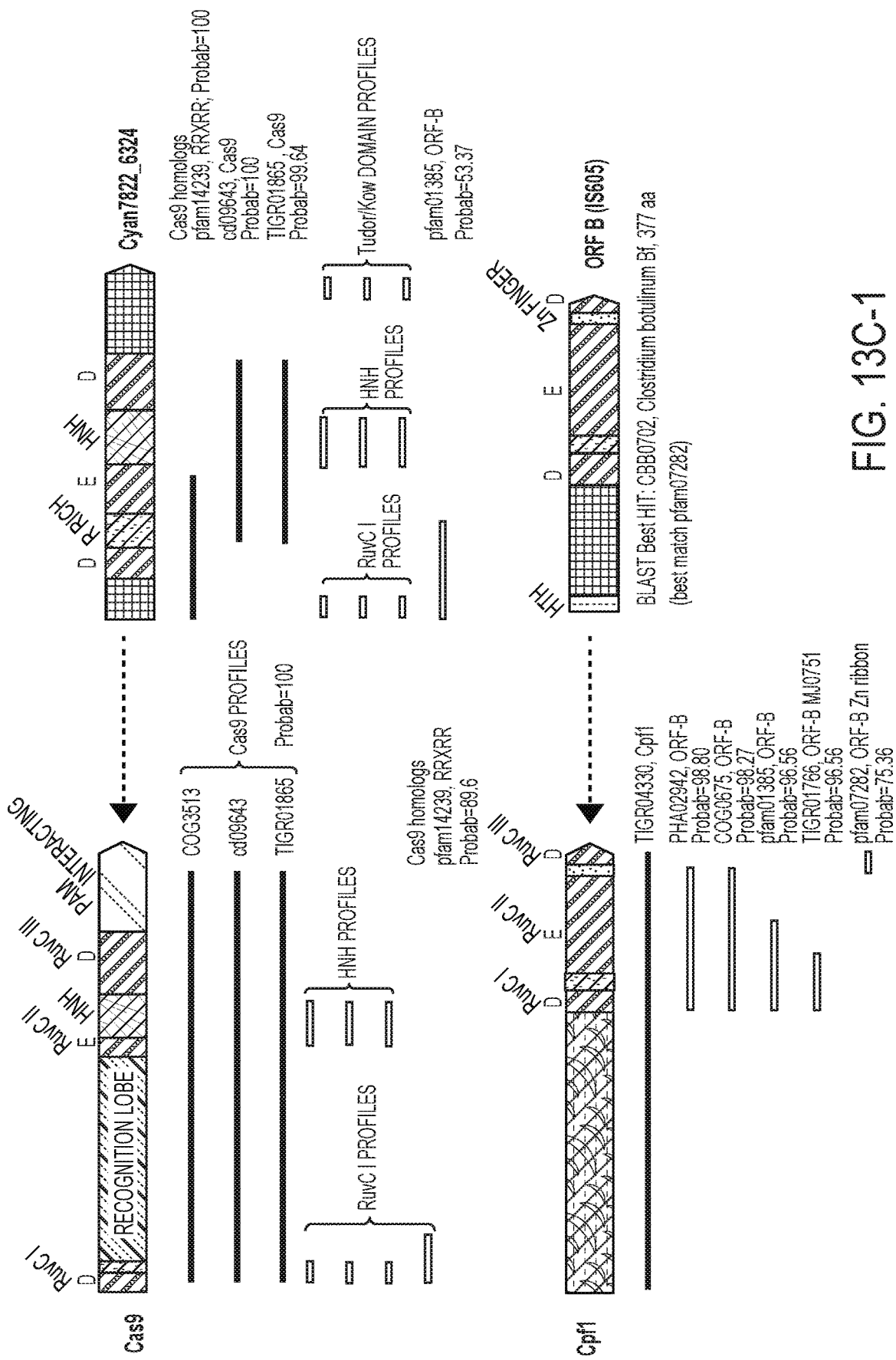
Figures 2, 13C:
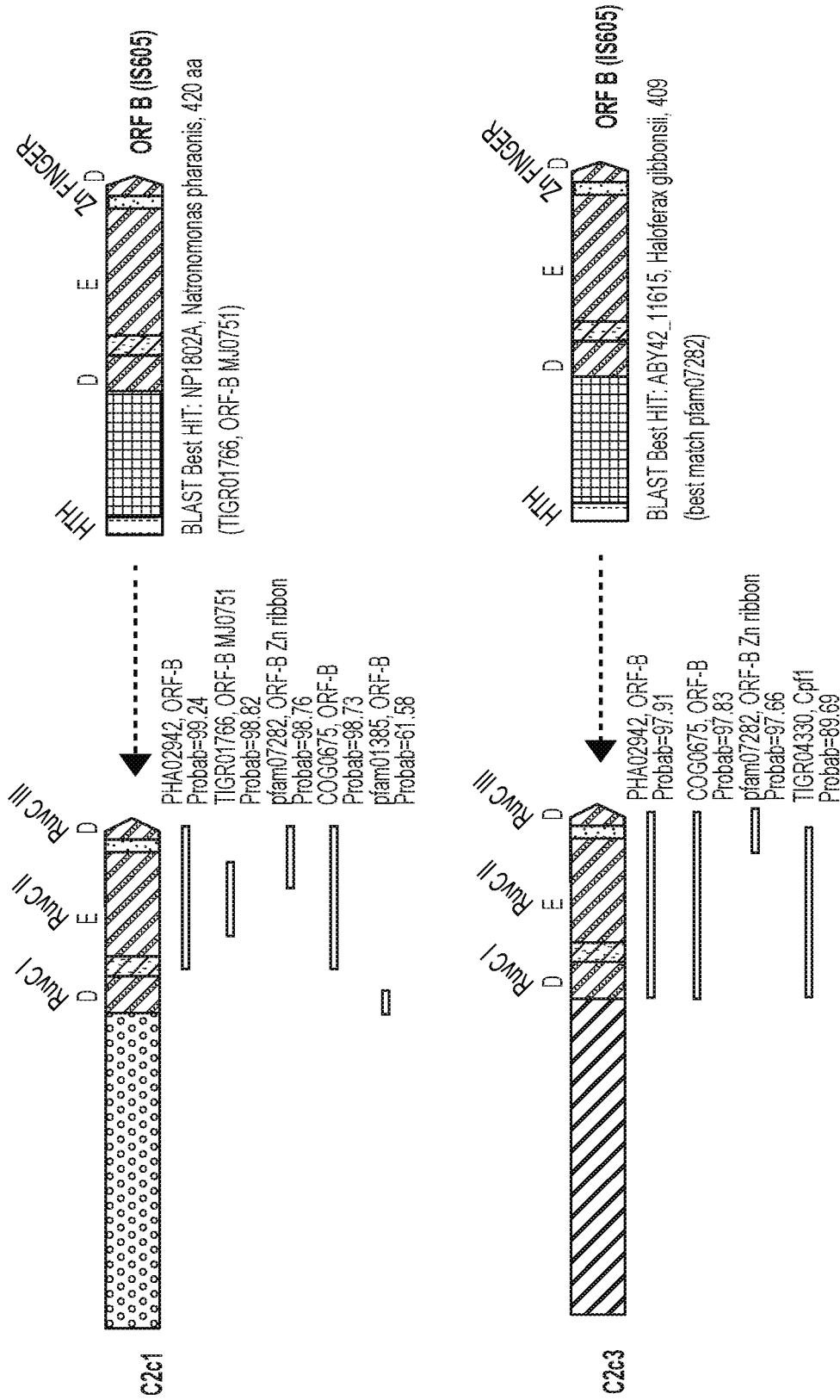
Figure 13E-4:
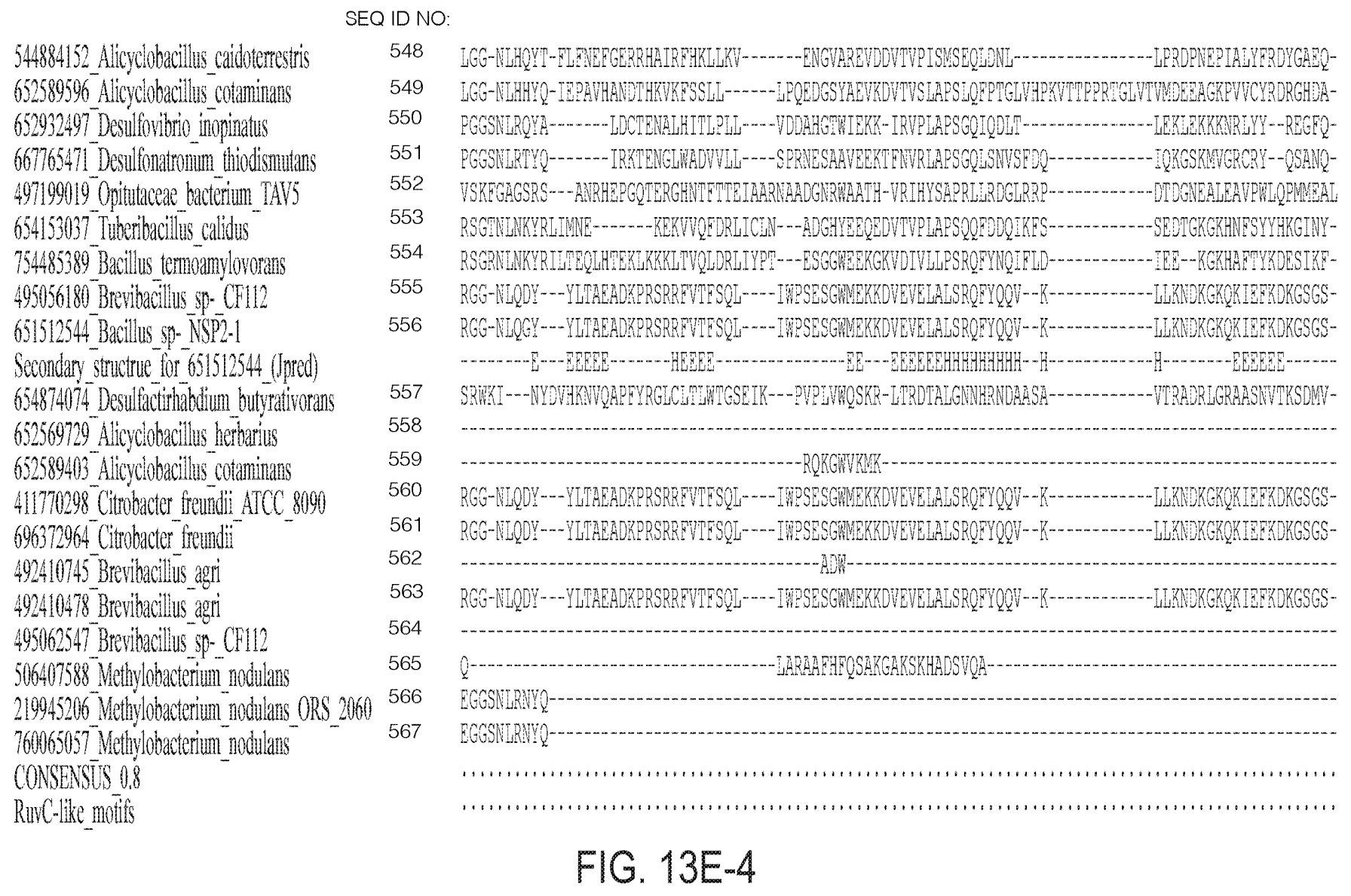
Figure 13F-3:
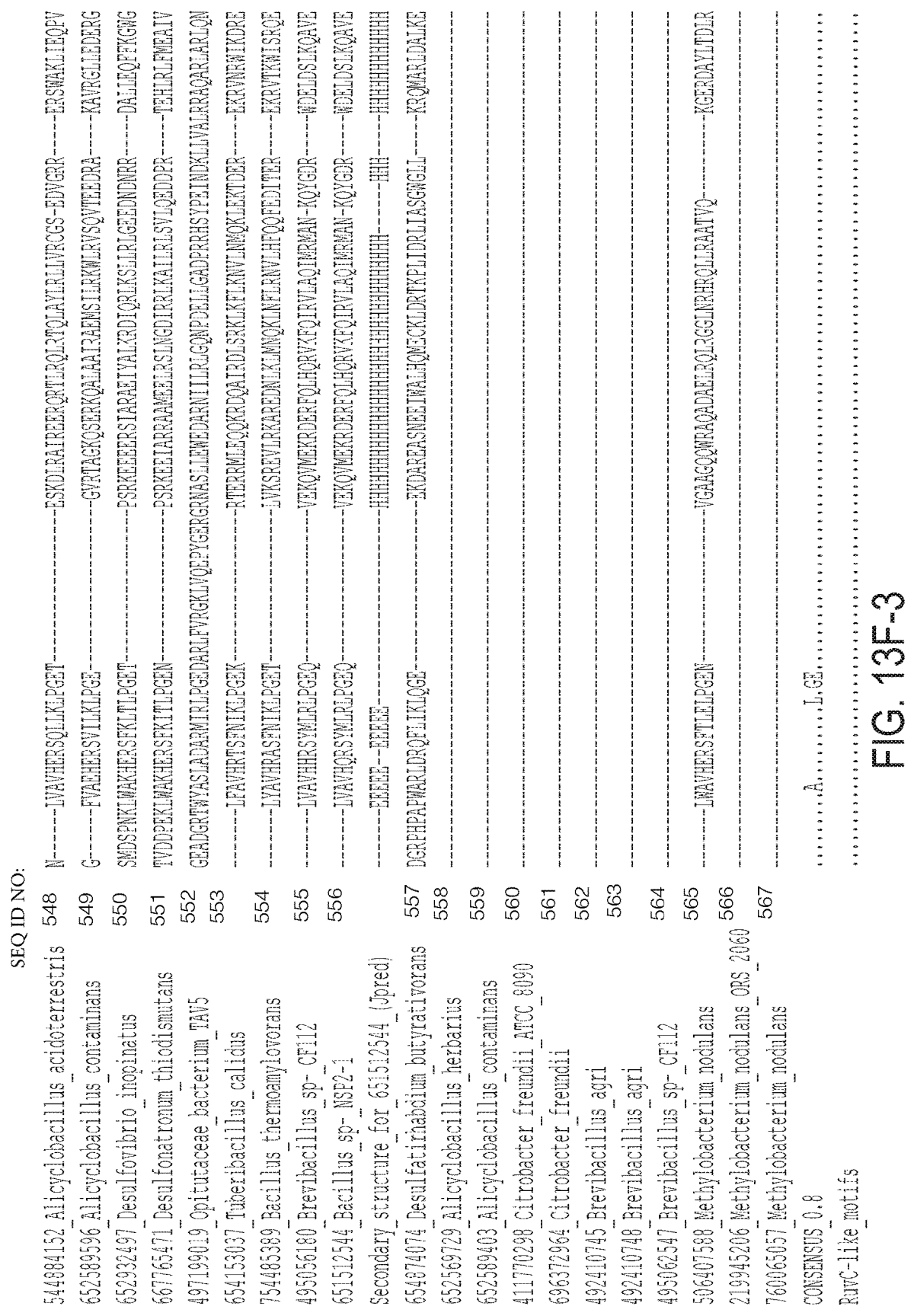
Figure 13G-3:
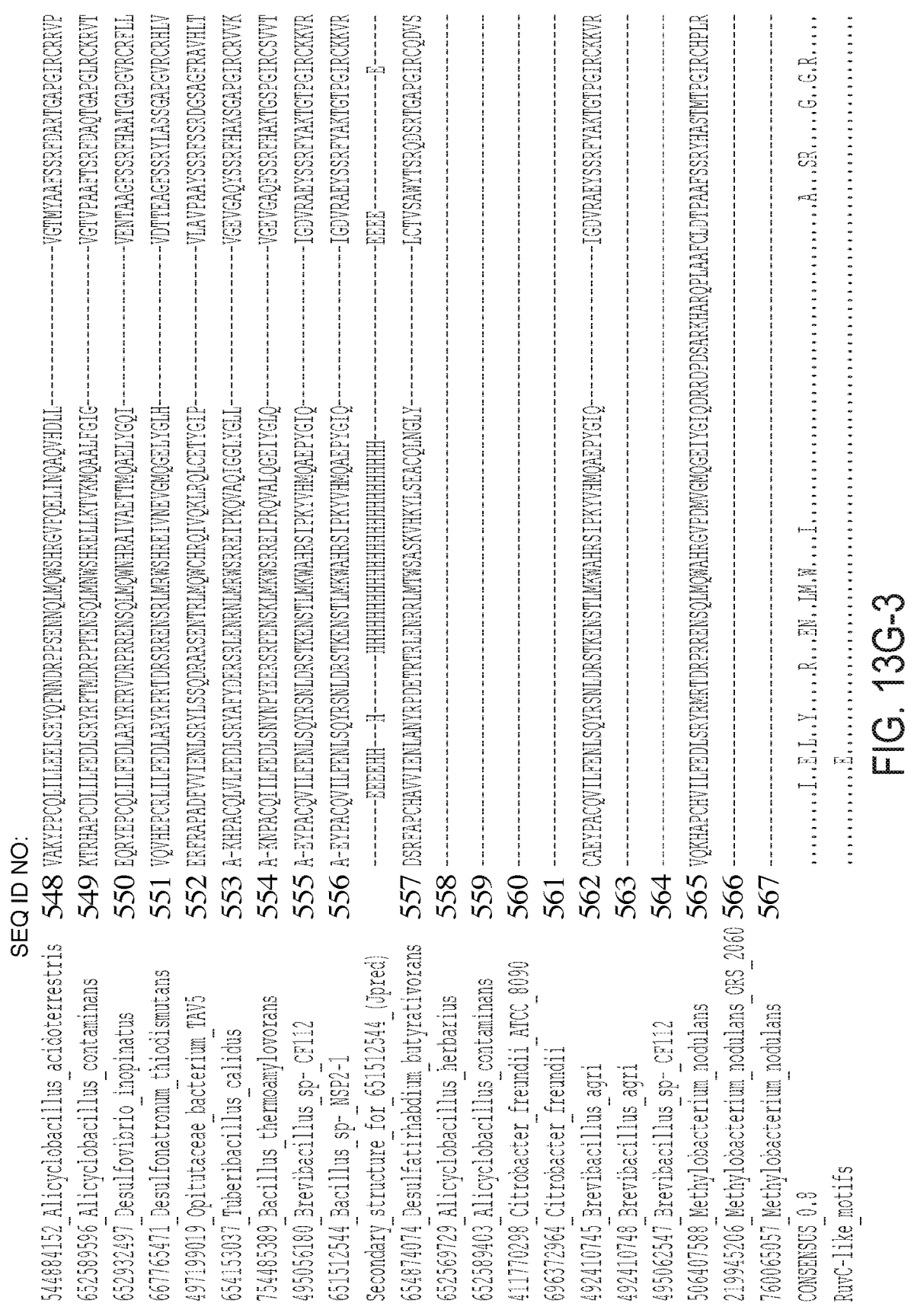
Figure 13I-1:
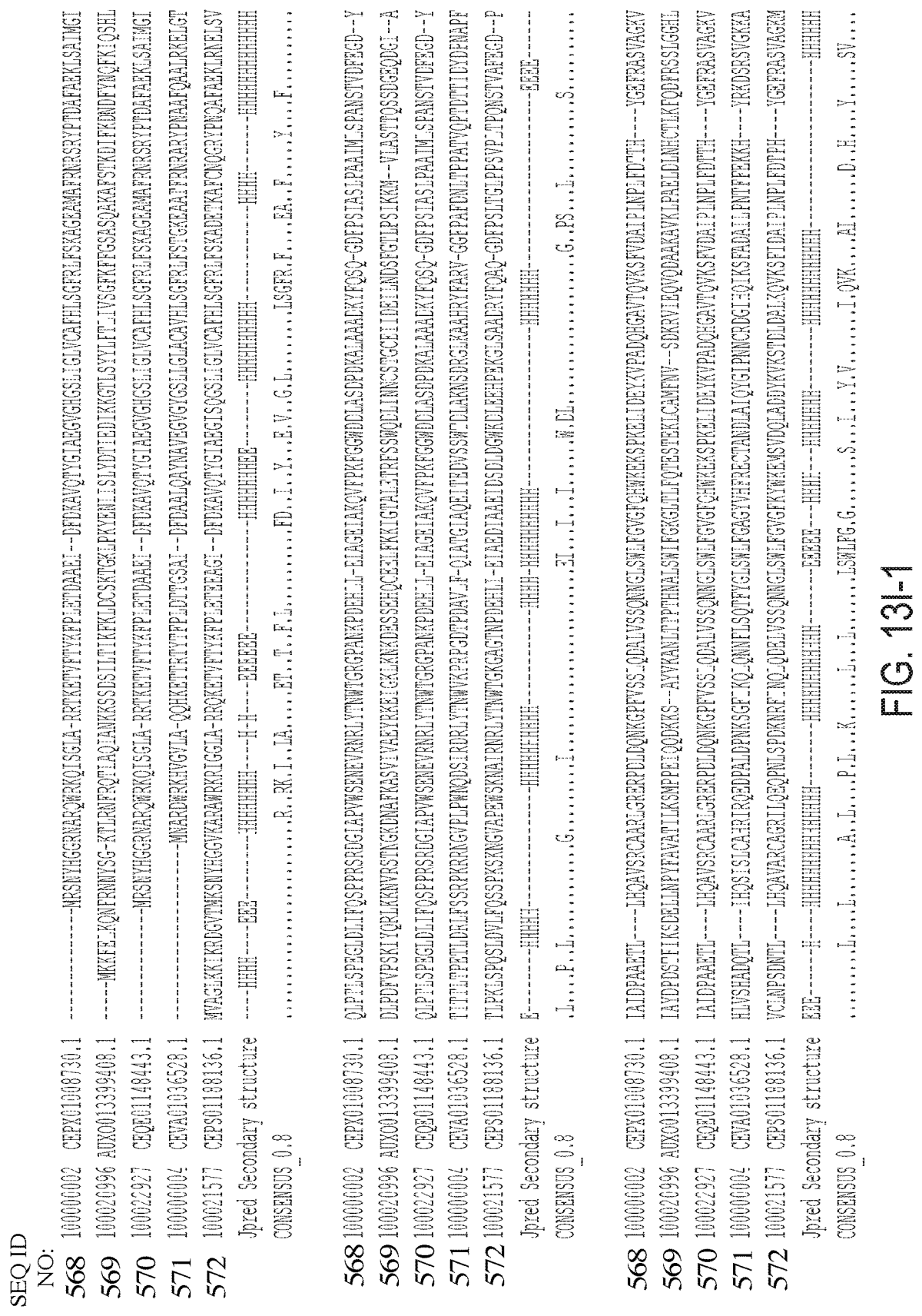
Figure 13I-2:
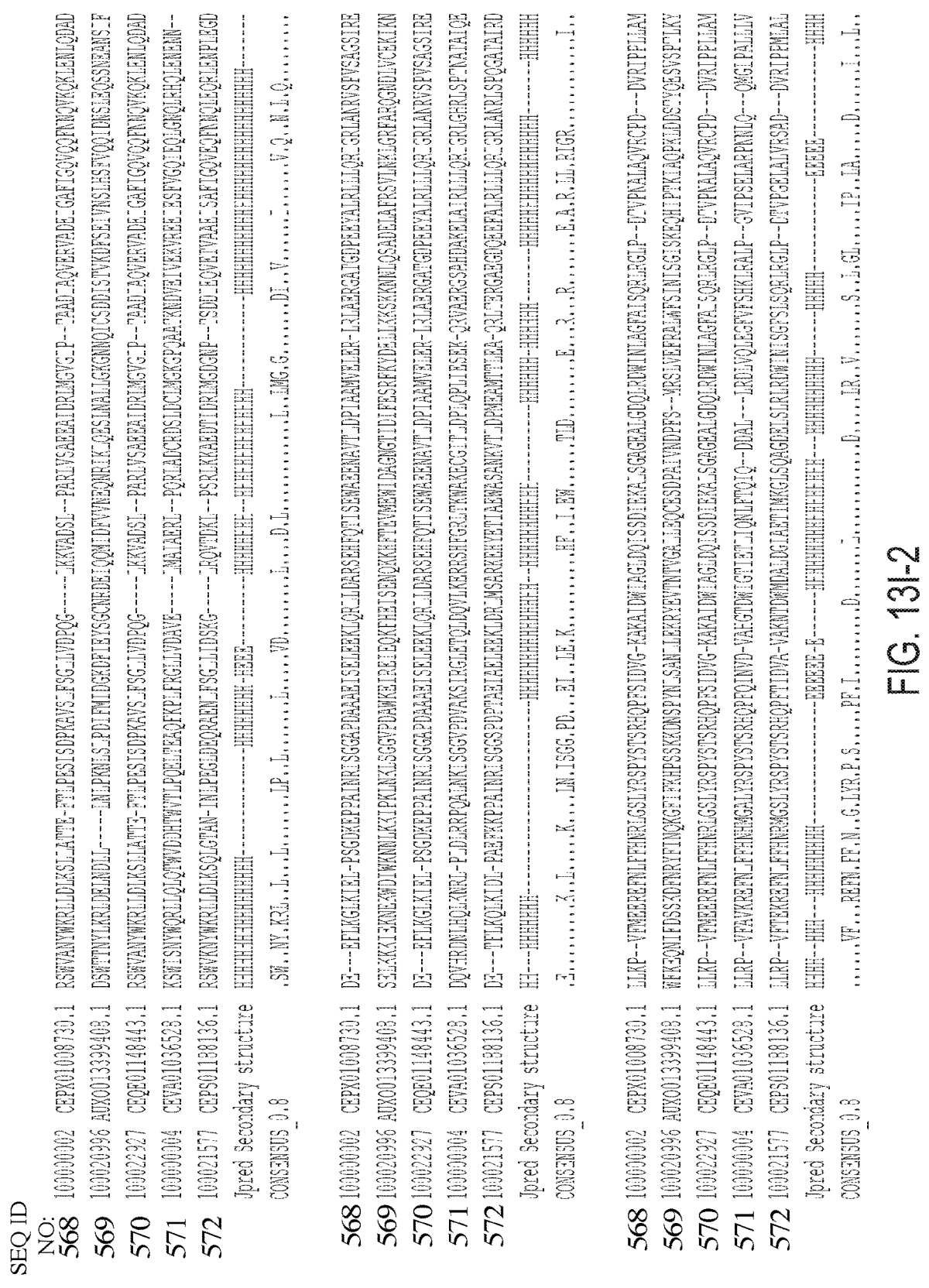

Combined with the results of previous analyses, (Chylinski, 2014; Makarova, 2011), the identification of the novel Class2 CRISPR-Cas systems reveals the dominant theme in the evolution of Class 2 CRISPR-Cas systems. The effector proteins of two of the three types within this class appear to have evolved from the pool of transposable elements that encode TnpB proteins containing the RuvC-like domain. The sequences of the RuvC-like domains of TnpB and the homologous domains of the Class 2 effector proteins are too diverged for reliable phylogenetic analysis. Nevertheless, for Cas9, the effector protein of Type II systems, the specific ancestral group seems to be readily identifiable, namely a family of TnpB-like proteins, particularly abundant in Cyanobacteria, that show a relatively high sequence similarity to Cas9 and share with it the entire domain architecture, namely the RuvC-like and HNH nuclease domains and the arginine-rich bridge helix (Chylinski, 2014) (FIG. 11, FIGS. 13A-1-13A-2 and 13B, "Domain organization of class 2 families"; FIG. 12-1-12-2, FIGS. 13A-1-13A-2 and 13B, "TnpB homology regions in Class 2 proteins"). Unlike Cas9, it was impossible to trace Cpf1, C2c1, and C2c3 to a specific TnpB family; despite the conservation of all motifs centered at the catalytic residues of the RuvC-like nucleases, these proteins show only a limited similarity to generic profiles of the TnpB. However, given that C2c1p shows no detectable sequence similarity with Cpf1, that Cpf1, C2c1, and C2c3 contain distinct insertions between the RuvC-motifs and clearly unrelated N-terminal regions, it appears most likely that Cpf1, C2c1, and C2c3 originated independently from different families within the pool of TnpB-encoding elements (FIG. 13C-1-13C-2).

It is intriguing that the TnpB proteins seem to be "pre-designed" for utilization in Class 2 CRISPR-Cas effector complexes such that they apparently have been recruited on multiple different occasions. Conceivably, such utility of TnpB proteins has to do with their predicted ability to cut a single-stranded DNA while bound to a RNA molecule via the R-rich bridge helix that in Cas9 has been shown to bind crRNA (Jinek, 2014; Nishimasu, 2014; Anders et al., 2014, Nature, vol. 513, 569-573). The functions of TnpB in the life cycles of the respective transposons are poorly understood. These proteins are not required for transposition, and in one case, a TnpB protein has been shown to down-regulate transposition (Pasternak, 2013) but their mechanism of action remains unknown. Experimental study of TnpB is likely to shed light on the mechanistic aspects of the Class 2 CRISPR-Cas systems. It should be noted that the mechanisms of Cpf1 and C2c1 could be similar to each other but are bound to substantially differ from that of Cas9 because the former two proteins lack the HNH domain that in Cas9 is responsible for nicking one of the target DNA strands (Gasiunas, 2012) (Jinek, 2012) (Chen, 2014). Accordingly, exploitation of Cpf1 and C2c1 might bring additional genome editing possibilities.

In evolutionary terms, it is striking that Class 2 CRISPR-Cas appear to be completely derived from different transposable elements given the recent evidence on the likely origin of cas1 genes from a distinct transposon family (Koonin, 2015; Krupovic, 2014). Furthermore, the likely independent origin of the effector proteins from different families of TnpB, along with the different phylogenetic affinities of the respective cas1 proteins, strongly suggest that Class 2 systems have evolved on multiple occasions through the combination of various adaptation modules and transposon-derived nucleases giving rise to effector proteins. This mode of evolution appears to be the ultimate manifestation of the modularity that is characteristic of CRISPR-Cas evolution (Makarova, 2015), with the implication that additional combinations of adaptation and effector module are likely to exist in nature.

The putative Type VI CRISPR-Cas systems encompass a predicted novel effector protein that contains two predicted HEPN domain that are likely to possess RNAse activity. The HEPN domains are not parts of the effector complexes in other CRISPR-Cas systems but are involved in a variety of defense functions including a predicted ancillary role in various CRISPR-Cas systems (Anantharaman, 2013) (Makarova, 2015). The presence of the HEPN domains as the catalytic moiety of the predicted effector module implies that the Type VI systems target and cleave mRNA. Previously, mRNA targeting has been reported for certain Type III CRISPR-Cas systems (Hale, 2014; Hale, 2009) (Peng, 2015). Although HEPN domains so far have not been detected in bona fide transposable elements, they are characterized by high horizontal mobility and are integral to mobile elements such as toxin-antitoxin units (Anantharaman, 2013). Thus, the putative Type VI systems seem to fit the general paradigm of the modular evolution of Class 2 CRISPR-Cas from mobile components, and additional variants and new types are expected to be discovered by analysis of genomic and metagenomics data. Given that the C2c2 protein is unrelated to the other Class 2 effectors (which all contain RuvC-like domains, even if distantly related ones), the discovery of type VI can be considered to corroborate the case for the independent origins of different Class 2 variants.

Figure 53:
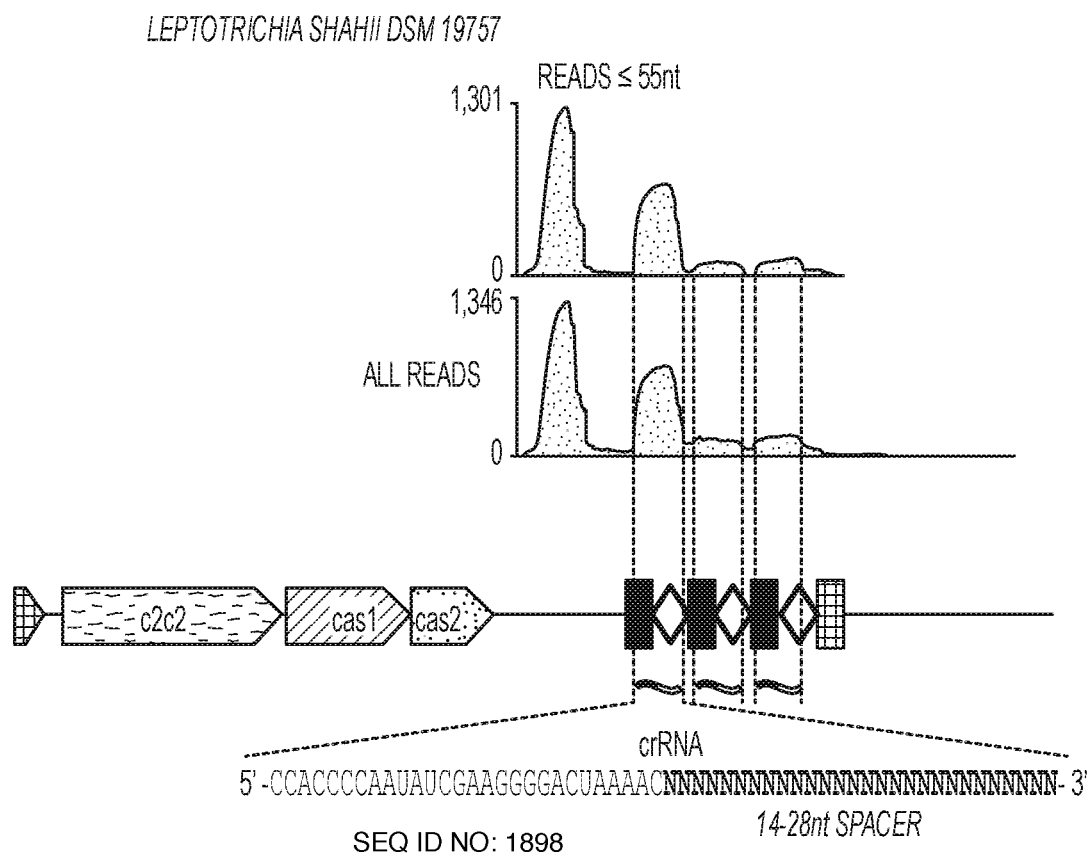
FIG. 53 depicts RNAseq analysis of an endogenous locus from *Leptotrichia shahii* DSM 19757. Figure discloses SEQ ID NO: 1898.

In view of the emerging scenario of the evolution of Class 2 systems from mobile elements, it seems instructive to examine the overall evolution of CRISPR-Cas loci and in particular the contributions of mobile elements to this process (FIG. 53). The ancestral adaptive immunity system most likely originated via the insertion of a casposon (a Cas1-encoding transposon) adjacent to a locus that encoded a primitive innate immunity system; Koonin and Krupovic, 2015, Nature reviews Genetics, vol. 16, 184-192; Krupovic et al., 2014, BMC Biology, vol. 12, 36). An additional important contribution was the incorporation of a toxin-antitoxin system that delivered the cas2 gene and might have occurred either in the ancestral casposon or in the evolving adaptive immunity locus (FIG. 51).

Figure 10A:
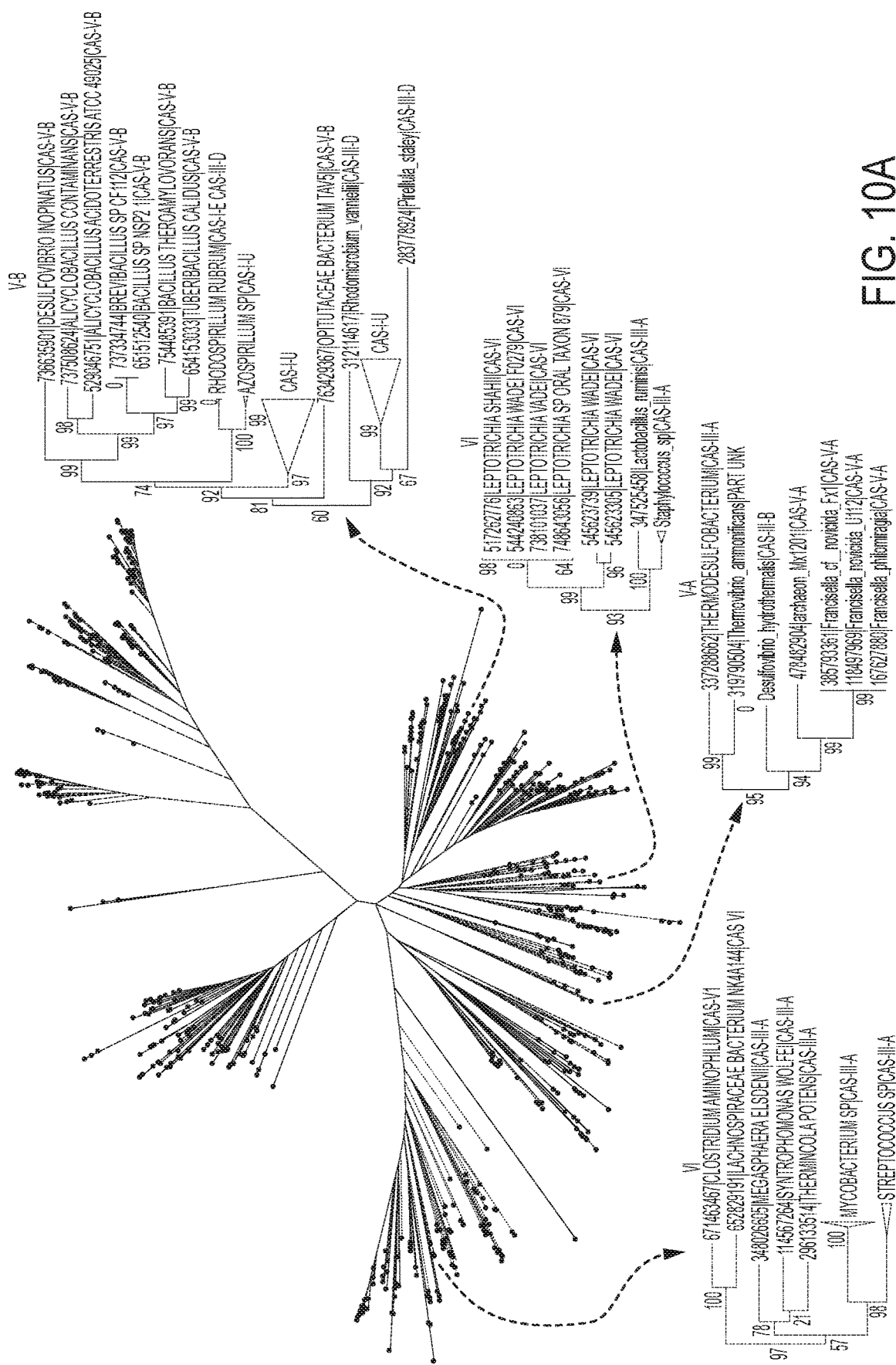
FIGS. 10A-10B.
Figure 10B:
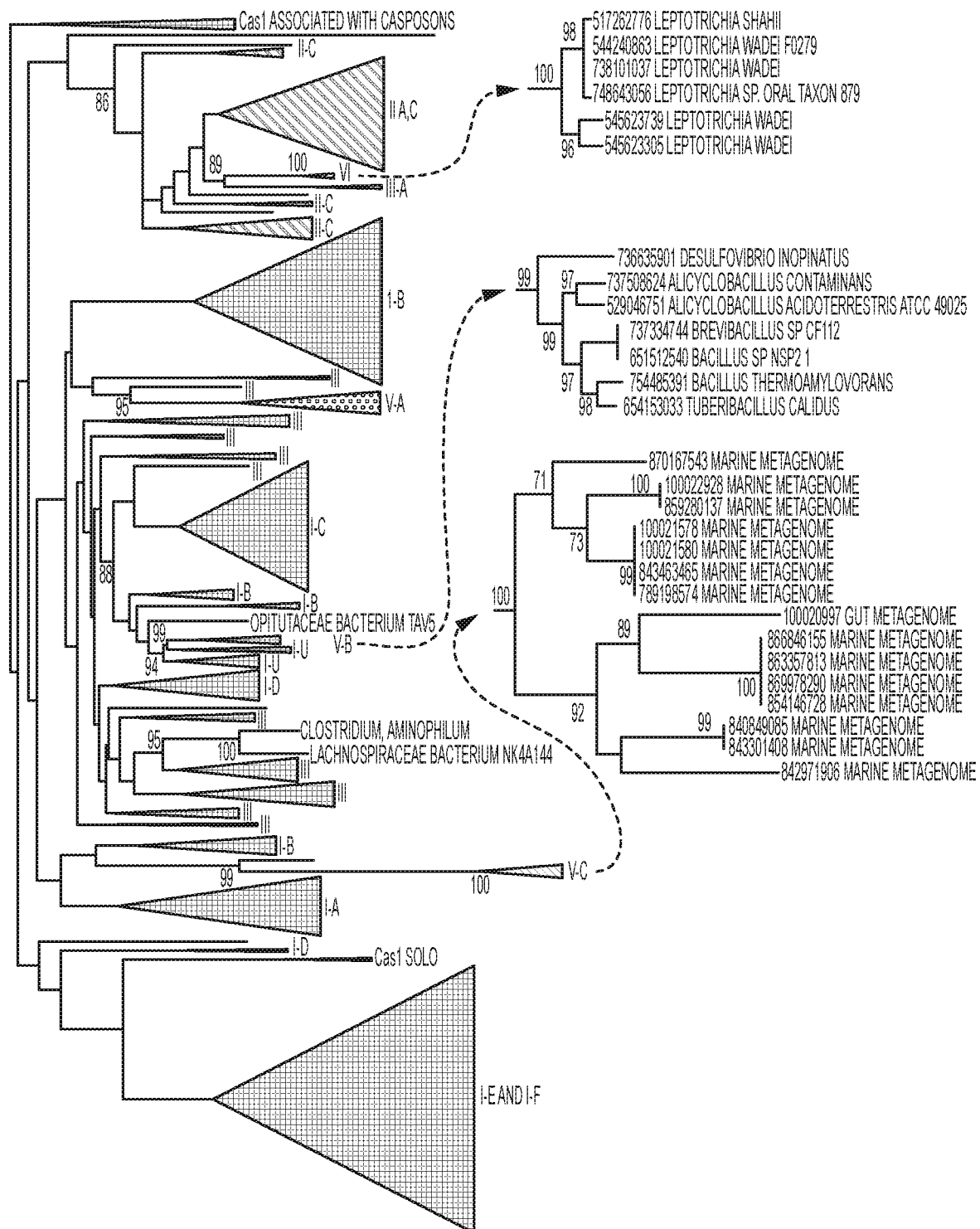
Figure 11:
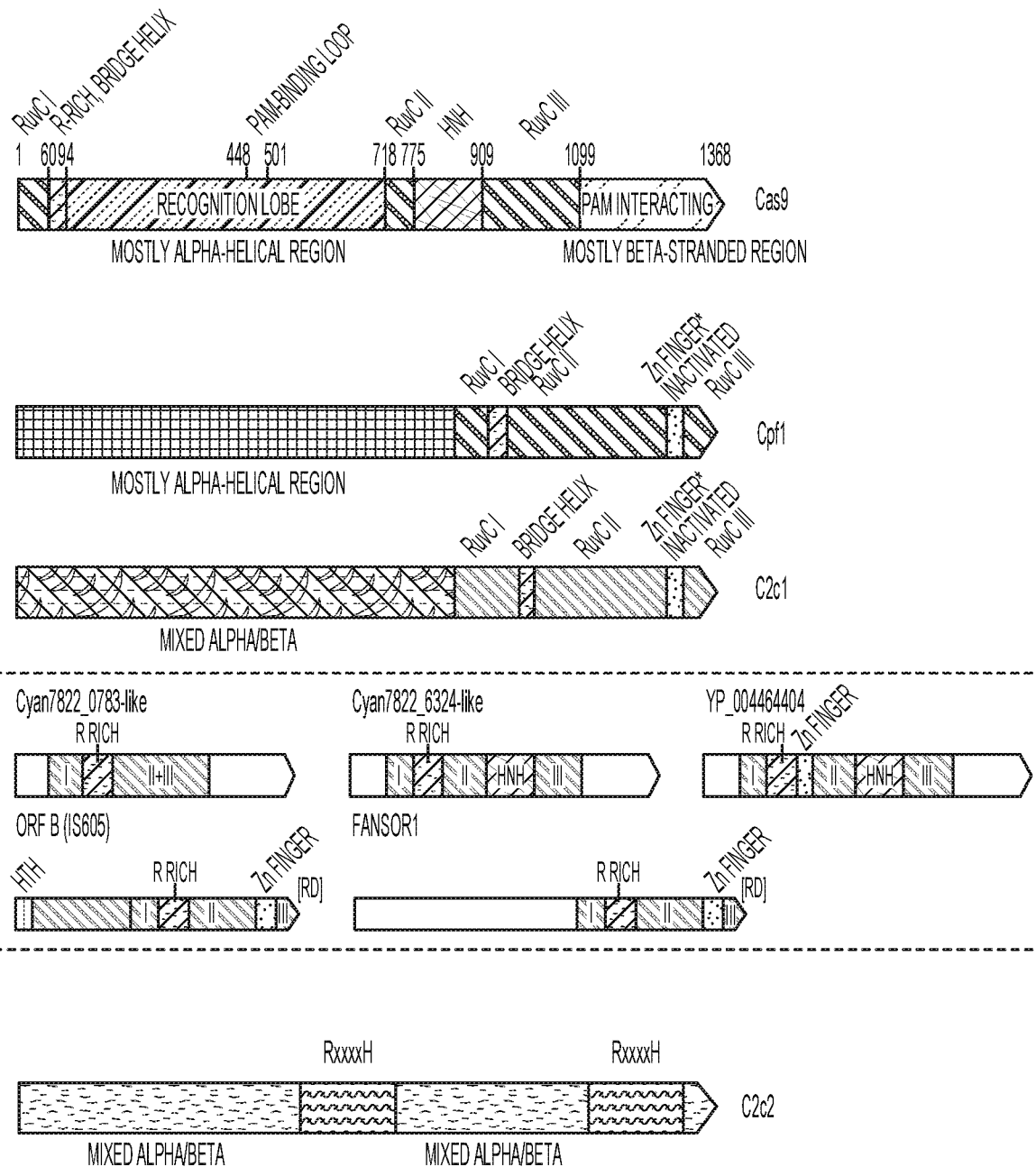
FIG. 11 depicts a domain organization of class 2 families.
Figure 51:
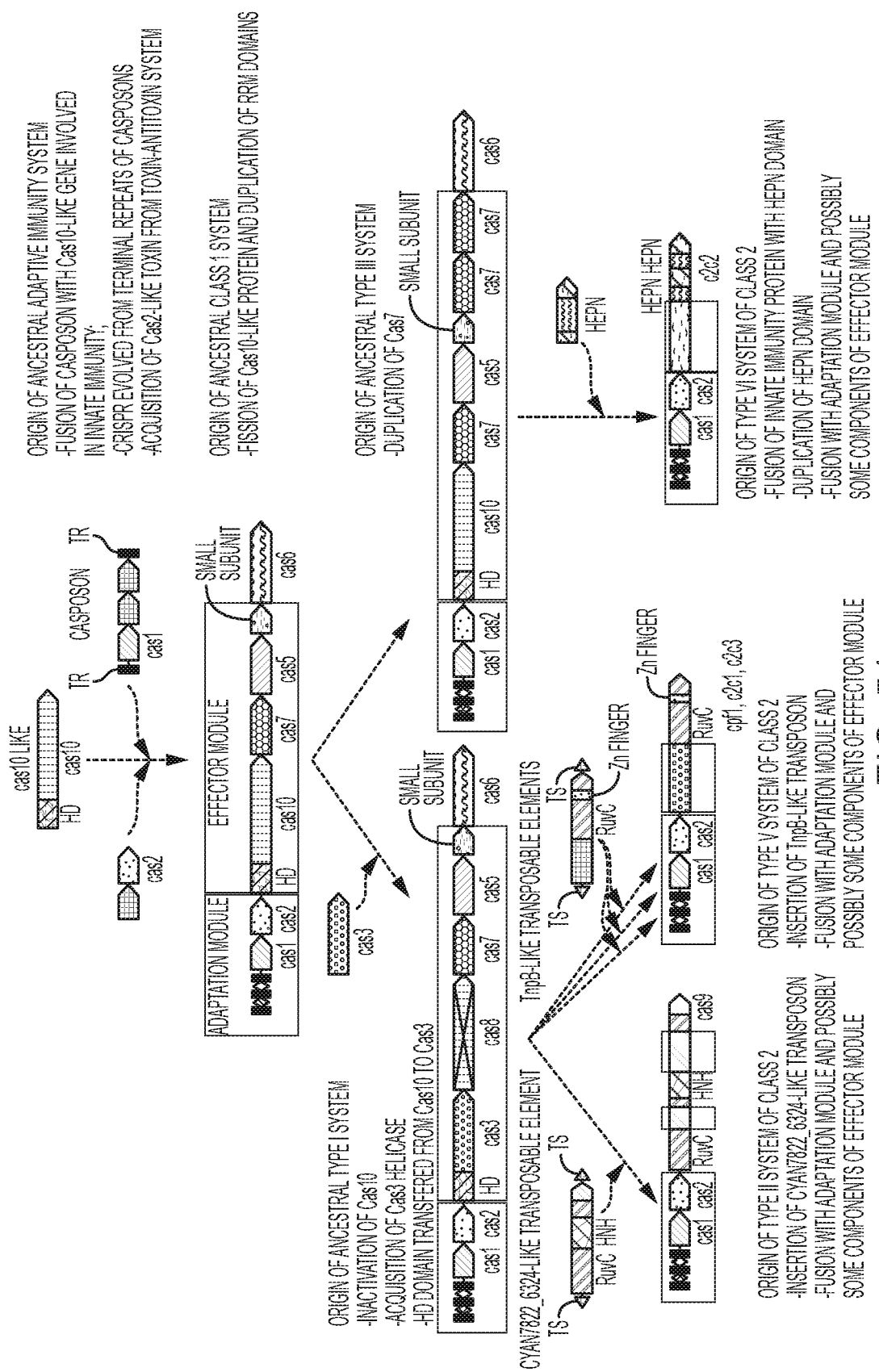
FIG. 51 shows evolutionary scenario for the CRISPR-Cas systems. The Cas8 protein is hypothesized to have evolved by inactivation of Cas10 (shown by the white X) which was accompanied by a major acceleration of evolution. Abbreviations: TR, terminal repeats; TS, terminal sequences; HD, HD family endonuclease; HNH, HNH family endonuclease; RuvC, RuvC family endonuclease; HEPN, putative endoribonuclease of HEPN superfamily. Genes and protein regions shown in gray denote sequences that were encoded in the respective mobile elements but were eliminated in the course of evolution of CRISPR-Cas systems.
Figure 52:
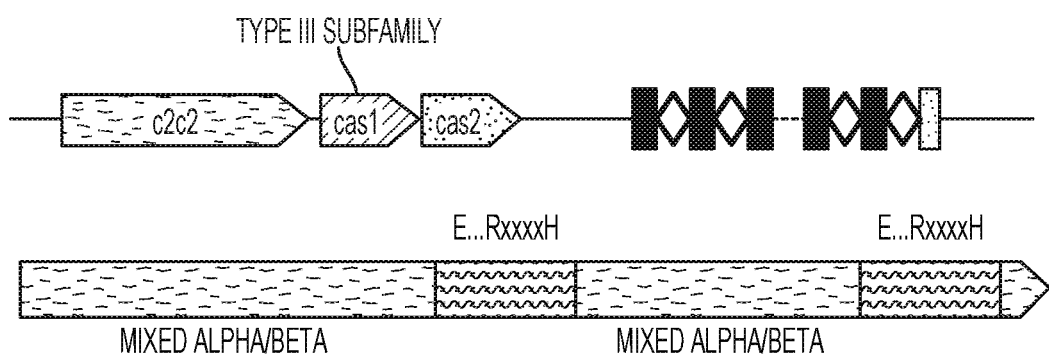
FIG. 52 depicts arrangement of C2c2 gene locus, including domains belonging to the HEPN domain superfamily. The majority of HEPN domains contain conserved motifs and constitute metal-independent endoRNases.

Given the extremely wide spread of Class 1 systems in archaea and bacteria and the proliferation of the ancient RRM (RNA Recognition Motif) domains in them, there seems to be little doubt that the ancestral system was of Class 1 (FIG. 51). Most likely, the ancestral architecture resembled the extant type III and in that it encompassed an enzymatically active Cas10 protein (Makarova et al., 2011, Biol Direct, vol. 6, 38; Makarova et al., 2013, Biochem Soc Trans, vol. 41, 1392-1400). The Cas10 protein is a homolog of family B DNA polymerases and nucleotide cyclases of the GGDEF family that shows significant sequence similarity to these enzymes and retains all the catalytic amino acid residues (Makarova et al., 2011, Biol Direct, vol. 6, 38; Makarova et al., 2006, Biol Direct, vol. 1, 7). Structural analysis has confirmed the presence of the polymerase-cyclase-like domain in Cas10 and additionally revealed a second, degenerate and apparently inactive domain of this family (Khachatryan et al., 2015, Phys Rev Lett, vol. 114, 051801; Shao et al., 2013, Structure, vol. 21, 376-384; Zhu and Ye, 2012, FEBS Lett, vol. 586, 939-945). The exact nature of the catalytic activity of Cas10 remains unclear but it has been shown that the catalytic residues of the polymerase-cyclase-like domain are essential for the target DNA cleavage (Samai et al., 2015, Cell, vol. 161, 1164-1174). The Cas8 proteins present in type I CRISPR-Cas systems are similar in size to Cas10 and occupy equivalent positions in the effector complexes (Jackson et al., 2014, Science, vol. 345, 1473-1479; Jackson and Wiedenheft, 2015, Mol Cell, vol. 58, 722-728; Staals et al., 2014, Molecular cell, vol. 56, 518-530), suggestive of an evolutionary relationship between the large subunits of the type III and type I effector complexes. More specifically, the Cas8 proteins that have highly diverged in sequence between type I subtypes could be catalytically inactive derivatives of Cas10 (Makarova et al., 2011, Biol Direct, vol. 6, 38; Makarova et al., 2015). This scenario suggests a plausible directionality of evolution, from type III-like ancestral Class 1 system to the type I systems. The divergence of the type III and type I systems could have been precipitated by the acquisition of the Cas3 helicase by the emerging type I (FIG. 53). The different types and subtypes of Class 2 then evolved via multiple substitutions of the gene block encoding the Class 1 effector complexes via insertion of transposable elements encoding various nucleases (FIG. 53). This particular directionality of evolution follows from the observation that the adaptation modules of different Class 2 variants derive from different Class 1 types (FIGS. 10A and 10B).

The Class 2 CRISPR-Cas systems appear to have been completely derived from different mobile elements. Specifically, there seem to have been at least two (in subtype V-C) but typically, three or, in the case of type II, even four mobile element contributors: (i) the ancestral casposon, (ii) the toxin-antitoxin module that gave rise to Cas2, (iii) a transposable element, in many cases a TnpB-encoding one, that was the ancestor of the Class 2 effector complex, and (iv) in the case of type II, the HNH nuclease could have been donated to the ancestral transposon by a group I or group II self-splicing intron (Stoddard, 2005, Q Rev Biophys, vol. 38, 49-95) (FIG. 53). The putative type V-C loci described here encode the ultimate minimalistic CRISPR-Cas system, the only currently identified one that lacks Cas2; conceivably, the highly diverged subtype V-C Cas1 proteins are capable of forming the adaptation complex on their own, without the accessory Cas2 subunit. The multiple originations of Class 2 systems from mobile elements present the ultimate manifestation of the modularity that is characteristic of the evolution of CRISPR-Cas (Makarova et al., 2015).

The demonstration that different varieties of Class 2 CRISPR-Cas systems independently evolved from different transposable elements implies that additional variants and new types remain to be identified. Although most if not all of the new CRISPR-Cas systems are expected to be rare, they could employ novel strategies and molecular mechanisms and could provide a major resource for new, versatile applications in genome engineering and biotechnology.

Modular evolution is a key feature of CRISPR-Cas systems. This mode of evolution appears to be most pronounced in Class 2 systems that evolve through the combination of adaptation modules from various other CRISPR-Cas systems with effector proteins that seem to be recruited from mobile elements on multiple independent occasions. Given the extreme diversity of mobile elements in bacteria, it appears likely that effector modules of Class 2 CRISPR-Cas systems are highly diverse as well. Here Applicants employed a simple computational approach to delineate three new variants of CRISPR-Cas systems but many more are likely to exist bacterial genomes that have not yet been sequenced. Although most if not all of these new CRISPR-Cas systems are expected to be rare, they could employ novel strategies and molecular mechanisms and would provide a major resource for new applications in genome engineering and biotechnology.

TBLASTN program with the E-value cut-off of 0.01 and low complexity filtering turned off parameters was used to search with Cas1 profile (Makarova et al., 2015) as a query against NCBI WGS database. Sequences of contigs or complete genome partitions where Cas1 hit has been identified were retrieved from the same database. The region around the Cas1 gene (the region 20 kb from the start of the Cas1 gene and 20 kb from the end of the Cas1 gene) was extracted and translated using GeneMarkS (Besemer et al., 2001, supra). Predicted proteins from each Cas1-encoding region were searched against a collection of profiles from CDD database (Marchler-Bauer, 2009) and specific Cas protein profiles (Makarova et al., 2015) using the RPS-BLAST program (Marchler-Bauer et al., 2002, Nucleic Acids Res, vol. 30, 281-283). Procedure to identify completeness of CRISPR loci and to classify CRISPR-Cas systems into the existing types and subtypes (Makarova et al., 2015) developed previously has been applied to each locus.

CRISPRmap (Lange, 2013) was used for repeat classification.

Partial and/or unclassified loci that encompassed proteins larger than 500 amino acids were analyzed on a case-by-case basis. Specifically, each predicted protein encoded in these loci was searched using iterative profile searches with the PSI-BLAST (Altschul, 1997), and composition based-statistics and low complexity filtering turned off, to search for distantly similar sequences against NCBI's non-redundant (NR) protein sequence database. Each identified non-redundant protein was searched against WGS database using the TBLAST program (Altschul, 1997). The HHpred program was used with default parameters to identify remote sequence similarity (Soding, 2005) using as the queries all proteins identified in the BLAST searches. Multiple sequence alignments were constructed using MUSCLE (Edgar, 2004) and MAFFT (Katoh and Standley, 2013, Mol Biol Evol, vol. 30, 772-780). Phylogenetic analysis was performed using the FastTree program with the WAG evolutionary model and the discrete gamma model with 20 rate categories (Price et al., 2010, PLoS One, vol. 5, e9490). Protein secondary structure was predicted using Jpred 4 (Drozdetskiy, 2015).

CRISPR repeats were identified using PILER-CR (Edgar, 2007, supra) or, for degenerate repeats, CRISPRfinder (Grissa et al., 2007, Nucleic Acids Res, vol. 35, W52-57). The Mfold program (Zuker, 2003, Nucleic Acids Res, vol. 31, 3406-3415) was used to identify the most stable structure for the repeat sequences.

The spacer sequences were searched against the NCBI nucleotide NR and WGS databases using MEGABLAST (Morgulis et al., 2008, Bioinformatics, vol. 24, 1757-1764) with default parameters except that the word size was set at 20.

Chosen Gene Candidates

```
Gene ID: A; Gene Type: C2C1; Organism: 5. Opitutaceae bacterium TAV5; Spacer
Length-mode (range): 34 (33 to 37); DR1:
GCCGCAGCGAAUGCCGUUUCACGAAUCGUCAGGCGG (SEQ ID NO: 27); DR2: none;
tracrRNA1:
GCUGGAGACGUUUUUUGAAACGGCGAGUGCUGCGGAUAGCGAGUUUCUCUUGGG
GAGGCGCUCGCGGCCACUUUU (SEQ ID NO: 28); tracrRNA2: none; Protein Sequence:
MSLNRIYQGRVAAVETGTALAKGNVEWMPAAGGDEVLWQHHELFQAAINYYLVALL
ALADK1WPVLGPLISQMDNPQSPYHVWGSFRRQGRQRTGLSQAVAPYTTPGNNAPTLD
EVFRSILAGNPTDRATLDAALMQLLKACDGAGAIQQEGRSYWPKFCDPDSTANFAGDP
AMLRREQHRLLLPQVLHDPAITHDSPALGSFDTYSIATPDTRTPQLTGPKARARLEQAIT
LWRVRLPESAADFDRLASSLKKIPDDDSRLNLQGYVGSSAKGEVQARLFALLLFRHLER
SSFTLGLLRSATPPPKNAETPPPAGVPLPAASAADPVRIARGKRSFVFRAFTSLPCWHGG
DNIHPTWKSFDIAAFKYALTVINQIEEKTKERQKECAELETDFDYMHGRLAKIPVKYTTG
EAEPPPILANDLRIPLLRELLQNIKVDTALTDGEAVSYGLQRRTIRGFRELRRIWRGHAPA
GTVFSSELKEKLAGELRQFQTDNSTTIGSVQLFNELIQNPKYWPIWQAPDVETARQWAD
AGFADDPLAALVQEAELQEDIDALKAPVKLTPADPEYSRRQYDFNAVSKFGAGSRSAN
RHEPGQTERGHNTFTTEIAARNAADGNRWRATHVRIHYSAPRLLRDGLRRPDTDGNEA
LEAVPWLQPMMEALAPLPTLPQDLTGMPVFLMPDVTLSGERRILLNLPVTLEPAALVEQ
LGNAGRWQNQFFGSREDPFALRWPADGAVKTAKGKTHIPWHQDRDHFTVLGVDLGTR
DAGALALLNVTAQKPAKPVHRIIGEADGRTWYASLADARMIRLPGEDARLFVRGKLVQ
EPYGERGRNASLLEWEDARNIILRLGQNPDELLGADPRRHSYPEINDKLLVALRRAQAR
LARLQNRSWRLRDLAESDKALDEIHAERAGEKPSPLPPLARDDA1KSTDEALLSQRDIIR
RSFVQIANLILPLRGRRWEWRPHVEVPDCHILAQSDPGTDDTKRLVAGQRGISHERIEQIE
ELRRRCQSLNRALRHKPGERPVLGRPAKGEEIADPCPALLEKINRLRDQRVDQTAHAILA
AALGVRLRAPSKDRAERRHRDIHGEYERFRAPADFVVIENLSRYLSSQDRARSENTRLM
QWCHRQIVQKLRQirETYGIPVLAVPAAYSSRFSSRDGSAGFRAVHLTPDHRHRMPWS
RILARLKAHEEDGKRLEKTVLDEARAVRGLFDRLDRFNAGHVPGKPWRTLLAPLPGGP
VFVPLGDATPMQADLNAAINIALRGIAAPDRHDIHHRLRAENKKRILSLRLGTQREKAR
WPGGAPAVTLSTPNNGASPEDSDALPERVSNLFVDIAGVANFERVTIEGVSQKFATGRG
LWASVKQRAWNRVARLNETVTDNNRNEEEDDIPM (SEQ ID NO: 29)

Gene ID: B; Gene Type: C2C1; Organism:
7. Bacillus thermoamylovorans strain B4166; Spacer Length-mode
(range): 37 (35-38); DR1:
GUCCAAGAAAAAAGAAAUGAUACGAGGCAUUAGCAC (SEQ ID NO: 30); DR2: none;
tracrRNA1:
CUGGACGAUGUCUCUUUUAUUUCUUUUUUCUUGGAUCUGAGUACGAGCACCCAC
AUUGGACAUUUCGCAUGGUGGGUGCUCGUACUAUAGGUAAAACAAACCUUUUU
(SEQ ID NO: 31); tracrRNA2: none; Protein Sequence:
MATRSFILKIEPNEEVKKGLWKTHEVLNHGIAYYMNILKLIRQEAIYEHHEQDPKNPKK
VSKAEIQAELWDFVLKMQKCNSFTHEVDKDVVFNILRELYEELVPSSVEKKGEANQLSN
KFLYPLVDPNSQSGKGTASSGRKPRWYNLKIAGDPSWEEEKICKWEEDKKKDPLAKILG
KLAEYGLIPLFIPFTDSNEPIVKEIKWMEKSRNQSVRRLDKDMFIQALERFLSWESWNLK
VKEEYEKVEKEHKTLEERIKEDIQAFICSLEQYEKERQEQLLRDTLNTNEYRLSKRGLRG
WREIIQKWLKMDENEPSEKYLEVFKDYQRKHPREAGDYSVYEFLSKKENHFIRWNHPE
YPYLYATFCEIDKKKKDAKQQATFTLADPINHPLWVRFEERSGSNLNKYRILTEQLHTE
```

-continued

KLKKKLTVQU5RLIYPTESGGWEEKGKVDIVLLPSRQFYNQIFLDIEEKGKHAFTYKDES
IKFPLKGTLGGARVQFDRDHLRRYPHKVESGNVGRIYFNMTVNIEPTESPVSKSLKIHRD
DFPKFVNFKPKELTEWIKDSKGKKLKSGIESLEIGLRVMSIDLGQRQAAAASIFEVVDQK
PDIEGKLFFPIKGTELYAVHRASFNIKLPGETLVKSREVLRKAREDNLKLMNQKLNFLRN
VLHFQQFEDITEREKRVTKWISRQENSDVPLVYQDELIQIRELMYKPYKDWVAFLKQLH
KRLEVEIGKEVKHWRKSLSDGRKGLYGISLKNIDEIDRTRKFLLRWSLRPTEPGEVRRLE
PGQRFAIDQLNHLNALKEDRLKKMANTIIMHALGYCYDVRKKKWQAKNPACQIILFED
LSNYNPYEERSRFENSKLMKWSRREIPRQVALQGEIYGLQVGEVGAQFSSRFHAKTGSP
GIRCSVVTKEKLQDNRFFKNLQREGRLTLDKIAVLKEGDLYPDKGGEKFISLSKDRKLVT
THADINAAQNLQKRFWTRTHGFYKVYCKAYQVDGQTVYIPESKDQKQKIIEEFGEGYFI
LKDGVYBWGNAGKLKIKKGSSKQSSSELVDSDILKDSFDLASELKGEKLMLYRDPSGN
VFPSDKWMAAGVFFGKLERJLISKLTNQYSISTIEDDSSKQSM (SEQ ID NO: 32)

Gene ID: C; Gene Type: C2C1; Organism: 9. *Bacillus* sp. NSP2.1;'Spacer Length-
mode (range): 36 (35-42); DR1: GUUCGAAAGCUUAGUGGAAAGCUUCGUGGUUAGCAC
(SEQ ID NO: 33); DR2: none; tracrRNA1:
CACGGAUAAUCACGACUUUCCACUAAGCUUUCGAAUUUUAUGAUGCGAGCAUCCU
CUCAGGUCAAAAAA (SEQ ID NO: 34); tracrRNA2: none; Protein Sequence:
MAIRSIKLKLKTHTGPEAQNLRKGIWRTHRLLNEGVAYYMKMLLLFRQESTGERPKEEL
QEELICHIREQQQRNQADKNTQALPLDKALEALRQLYELLVPSSVGQSGDAQIISRKFLS
PLVDPNSEGGKGTSKAGAKITWQKKKEANDPTQQDYEKWKKRREEDPTASVITTLEE
YGIRPIFPLYTNTVTDIAWLPLQSNQFVRTWDRDMLQQAIERLLSWESWNKQQ
LKEKMAQLNEQLEGGQEWISLLEQYEENRERELRENMTAANDKYRITKRQMKGWNEL
YELWSTFPASASHEQYKEALKRVQQRLRGRFGDAHFFQYLMEEKNRLIWKGNPQRIHY
FVARNELTKRLEEAKQSATMTLPNARKHPLWVRFDARGGNLQDYYLTAEADKPRSRRF
VTFSQLIWPSESGWMEKKDVEVELALSRQFYQQVKLLKNDKGKQKIEFKDKGSGSTFN
GHLGGAKLQLERGDLEKEEKNFEDGEIGSVYLNVVIDFEPLQEVKNGRVQAPYGQVLQ
LIRRPNEFPKVTTYKSEQLVEWIKASPQHSAGVESLASGFRVMSIDLGLRAAAATS1FSVE
ESSDKNAADFSYWIEGTPLVAVHQRSYMLRLPGEQVEKQVMEKRDERFQLHQRVKFQI
RVLAQIMRMANKQYGDRWDELDSLKQAVEQKKSPLDQTDRTFWEGIVCDLTKVLPRN
EADWEQAWQIHRKAEEYVGKAVQAWRKRFAADERKGIAGLSMWNIEELEGLRKLLIS
WSRRTRNPQEVNRFERGHTSHQRLLTHIQNVKEDRLKQLSHAIVMTALGYVYDERKQE
WCAEYPACQVILFENLSQYRSNLDRSTKENSTLMKWAHRSIPKYVHMQAEPYGIQIGDV
RAEYSSRFYAKTGTPGIRCKKVRGQDLQGRRFENLQKRLVNEQFLTEEQVKQLRPGDIV
PDDSGELFMTLTDGSGSKEWFLQADINAAHNLQKRFWQRYNELFKVSCRVIVRDEEE
YLVPKTKSVQAKLGKGLFVKKSDTAWKDVYVWDSQAKLKGKTTFTEESESPEQLEDFQ
EIIEEAEEAKGTYRTLFRDPSGVFFPESVWYPQKDFWGEVKRKLYGKLRERFLTKAR
(SEQ ID NO: 35)

Gene ID: D; Gene Type: C2C2; Organism:
4. *Lachnospiraccae bacterium* NK4A144 G619; Spacer Length-mode
(range): 35; DR1:
GUUUUGAGAAUAGCCCGACAUAGAGGGCAAUAGAC (SEQ ID NO: 36); DR2:
GUUAUGAAAACAGCCCGACAUAGAGGGCAAUAGACA (SEQ ID NO: 37); tracrRNA1:
none; tracrRNA2: none; Protein Sequence:
MKISKVDHTRMAVAKGNQHRRDEISGILYKDPTKTGSIDFDERFKKLNCSAKILYHVFN
GIAEGSNKYKLVIVDKVNNNLDRVLTTGKSYDRKSnDIDTVLRNVEKINAFDRJSTEEREQ
IIDDLLEIQLRKGLRKGKAGLREVLLIGAGVIVRTDKKQEIADFLEILDEDFNKTNQAKNI
KLSIENQGLVVSPVSRGEERIFDVSGAQKGKSSKKAQEKEALSAFLLDYADLDKNVRFE
YLRKIRRLLVLYFVKNDDVMSLTEIPAEVNLEKDFDIWRDHEQRKEENGDFVGCPDILL
ADRDVKKSNSKQVKIAERQLRESIREKNIKRYRFSIKTIEKDDGTYFFANKQISVFWIHRI
ENAVERILGSINDIGAYRLRLGYLGEKVWKDILNFLTIKYIAVGKAVTQFAMDDLQEKD
RDIEPGKISENAVNGLTSFDYEQIKADEMLQREVAVNVAFAANNLARVTVDIPQNGEKE
DILLWNKSDIKKYKKNSKKGILKSILQFFGGASTWNMKMFEIAYHDQPGDYEENYLYDI
IQNYSLRNKSFHFKTYDHGDKNWNREIIGKMIHHDAERVISVEREKFHSNNLPMFYKDA
DLKKILDLLYSDYAGRASQVPAITVLVRKNFPEFLRKDMGYKVHFNNPEVENQWHSA
VYYLYKEIYYNLFLRDKEVKNLFYTSLKNIRSEVSDKKQKLASDDFASRCEEIEDRSLPEI
CQIIMTEYNAQNFGNRKVKSQRVIEKNKDIFRHYKMLLIKTLAGAFSLYLKQERFAFIGK
ATPIPYETTDVKNFLPEWKSGMYASFVEEIKNNLDLQEWYIVGRFLNGRMLNQLAGSLR
SYIQYAEDIERRAAENRNKLFSKPDEKIEACKKAVRVLDLCIKISTRISAEFTDYFDSEDD
YADYLEKYLKYQDDAIKELSGSSYAALDHFCNKDDLKFDIYVNAGQKPILQRNIVMAK
LFGPDNILSEVMEKVTESAIREYYDYLKKVSGYRVRGKCSTEKEQEDLLKFQRLKNAVE
FRDVTEYAEVINELLGQLISWSYLRERDLLYFQLGFHYMCLKNKSFKPAEYVDIRRNNG
TIIHNAILYQIVSMYINGLDFYSCDKEGKTLKPIETGKGVGSKIGQFIKYSQYLYNDPSYK
LEIYNAGLEVFENIDEHDNITDLRKYVDHFKYYAYGNKMSLLDLYSEFFDRFFTYDMKY
QKNVVNVLENILLRHFVIFYPKFGSGKKDVGIRDCKKERAQIEISEQSLTSEDFMFKLDD
KAGEEAKKFPARDERYLQTIAKLLYYPNEIEDMNRFMKKGETINKKVQFNRKKKITRKQ
KNNSSNEVLSSTMGYLFKNIKL (SEQ ID NO: 38)

Gene ID: E; Gene Type: C2C2; Organism:
8. *Listeria seeligeri serovar 1/2b* str. SLCC3954; Spacer Length-
mode (range): 30; DR1:
GUUUAGUCCUCUUUCAUAUAGAGGUAGUCUCUUAC (SEQ ID NO: 39); DR2: none;
tracrRNA1:
AUGAAAAGAGGACUAAAACUGAAAGAGGACUAAAACACCAGAUGUGGAUAACUA
UAUUAGUGGCUAUUAAAAAUUCGUCGAUAUUAGAGGAAACUUU (SEQ ID NO:
40); tracrRNA2: none; Protein Sequence:
MWISIKTLIHHLGVLFFCDYMYNRREKKUEVKTMRITKVEVDRKKVLISRDKNGGKLV
YENEMQDNTEQIMHHKKSSFYKSVVNKTICRPEQKQMKKLVHGLLQENSQEKIKVSDV

```
TKLNISNFLNHRFKKSLYYFPENSPDKSEEYRIEINLSQLLEDSLKKQQGTFICWESFSKD
MELYINWAENYISSKTKLIKKSIRNNRIQSTESRSGQLMDRYMKDILNKNKPFDIQSVSE
KYQLEKLIALKATFKEAKICNDKEINYKLKSTLQNHERQIIEELKENSELNQFNIEIRKITL
ETYFPIKKTNRKVGDIRNLEIGEIQKIVNHRLICNKIVQRILQEGKLASYEIESTVNSNSLQK
IKIEEAFALKFINACLFASNNLRNMVYPVCKLVQDILMIGEFKNSFKEIKHKKFMQQQRR
QEITVDDIELASWGLRGAIAPIRNEIIHLKKHSWKKPFNNPTFKVKKSKIIINGKT
FLYKETLFKDYFYSELDSVPELIINKMESSKILDYYSSDQLNQVFTIPNFELSLLTSAVPFA
PSFKRVYLKGFDYQNQDEAQPDYNLKLNIYNEKAFNSEAFQAQYSLFKMVYYQVFLPQ
FTTNNDLFKSSVDFILTLNKERKGYAKAFQDIRKMNKDEKPSEYMSYIQSQLMLYQKKQ
EEKEKINHFEKFINQVFIKGFNSFIEKIIRLTYICHPTKNTVPENDNIEIPFHTDMDDSNIAF
WLMCIQLDAKQLSELRNEMIKFSCSLQSTEEISTFTKAREVIGLALLNGEKGCNDWKEL
FDDKEAWKKNMSLYVSEELLQSLPYTQEDGQTPVINRSIDLVKKYGTETILEKLFSSSDD
YKVSAKDIAKLHEYDVTEKIAQQESLHKQWIEKPGLARDSAWTKKYQNVINDISNYQW
AKTKVELTQVRHLHQLTIDLLSRLAGYMSIADRDFQFSSNYILERENSEYRVTSWILLSE
NKNKNKYNDYELYNLKNASIKVSSKNDPQLKVDLKQLRLTLEYLELFDNRLKEKKH
HFNYLNGQLGNSILELFDDARDVLSYDRKLKNAVSKSLKEILSSHGMEVTFKPLYQTNH
HLKIDKLQPKKIHHLGEKSTVSSNQVSNEYCQLVRTLLTMK (SEQ ID NO: 41)

Gene ID: F; Gene Type: C2C2; Organism: 12. Leptotrichia wadei F0279; Spacer
Length-mode (range): 31; DR1:
GUUUUAGUCCCCUUCGUUUUUGGGGUAGUCUAAAUC (SEQ ID NO: 42); DR2: none;
tracrRNA1:
GAUUUAGAGCACCCCAAAAGUAAUGAAAAAUUUGCAAUUAAAUAAGGAAUAUUAA
AAAAAUGUGAUUUAAAAAAAUUGAAGAAAUUAAAUGAAAAAUUGUCCAAGUAA
AAAAA (SEQ ID NO: 43); tiacrRNA2:
AUUUAGAUUACCCCUUUAAUUUAUUUUACCAUAUUUUUCUCAUAAUGCAAACUA
AUAUUCCAAAAUUUUU (SEQ ID NO: 44); Protein Sequence:
MGNLFGHKRWYEVRDKKDFKIKRKVKVKRNYTCNK
INYKKNDNILKEFTRKFHAGNILFKLKGKEGIIRIENNDDFLETEEVVLYIEAYGKSEKLK
ALGITKKKIIDEAIRQGITKDDKKIEIKRQENEEEIEIDIRDEYTNKTLNDCSIILRIIENGDLELE
TKKSIYEIFKNINMSLYKIIEKIIENETEKVFENRYYEEHLREKLLKDDKIDVILTNFMEIRE
KIKSNLEILGFVKFYLNVGGDKKKSKNKKMLVEKILNINVDLTVEDIADFVIKELEFWNf
TmEKVKKVNNEFLEKRRNRTYIKSYVLLDKHEKFKIERENKKDKIVKFFVENIKNNSI
KEKIEKILAEFKIDELIKKLEKELKKGNCDTEIFGIFKKHYKVNFDSKKFSKKSDEEKELY
KIIYRYLKGRIEKILWEQKVRLKKMEKIEIEKILNESILSEKLVLKRVKQYTLEHIMYLGKL
RHNDIDMTTWTDDFSRLHAKEELDLELITFFASTNMELNKIFSRENIHWQQQKDRDS
EKNYVLDKKILNSKIKIIRDLDFIDNKNNITNNFIRKFTKIGTNERNRILHAISKERDLQGT
QDDYNKVINNQNLKISDEEVSKALNLDVVFKDKKNIITKINDIKISEENNNRRKHHKDDKS
VLPEILNLYRNNPKNEPFDTIETEIGVLNALIYVNKELYKKLILEDDLEENRESKNIFLQELK
KTLGNIDEIDENUENYYKNAQISASKGNNKAIKKYQKKVIECYIGYLRKNYEELFDFSDF
KMNIQEIKXQIKDINDNKTYERITVKTSDKTIVINDDFEYIISIFALLNSNAVINW
TSVWLNTSEYQNIIDILDEIMQLNTLRNECITENWNLNLEEFIQKMKEIEKDFDDFKIQTK
KEIFNNYYEDIKNNILTEFKDDINGCDVLEKKLEKIVIFDDETKFEIDKKSNILQDEQRKLS
NINKKDLKICKVDQYIKDKIIQEIKSKILCRIIFNSDFLKKYKKYKKEIKNLIEDMESENENKFQE
IYYPKERKNELYIYKKNLFLNIGNPNFDKIYGLISNDIKMADAKFUIDGKNIRKNKISEI
DAILKNLNDKLNGYSKEYKEKYIKKLKENDDFFAKNIQNKNYKSFEKDYNRVSEYKKIR
DLVEFNYU+KIESYLIDINWKLAIQMARFERDMHYIVMGLRELGIIKLSGYNTGISRAYPK
RNGSIFFYTTTAYYKFFDEESYKKFEKICYGFGIDLSENSEINKPENESnWYISHFYIVRN
PFADYSIAEQIDRVSNLLSYSTRYNNSTYASVFEVFKKDVNLDYDELKKKFKLIGNNDIL
ERLMKPKKVSVLELESYNSDYIKNLHELLTKIENTNDTL (SEQ ID NO: 45)

Gene ID: G; Gene Type: C2C2; Organism: 14. Leptotrichia shahii
DSM 19757 B031;
Spacer Length-mode (range): 30 (30-32); DR1:
GUUUUAGUCCCCUUCGAUAUUGGGGUGGUCUAUAUC (SEQ ID NO: 46); DR2: none;
tracrRNA1:
AWGAUGUGGUAUACUAAAAAUGGAAAAUUGUAUUUUUGAUUAGAAAGAUGUAA
AAUUGAUUUAAUUUAAAAAUAUUUUAUUGAUUAAAGUAGA (SEQ ID NO: 47);
iracrRNA2: none; Protein Sequence:
MSIYQEFWKYSIKTLRFELIPQGKTLENIKARGLILDDEKRAKDYKKAKQIIDKYIIQF
FIEEEILSSVCISEDLLQNYSDVYFKLKKSDDDNLQKDFKSAKDTIICKQISEYIKDSEKFKN
LFNQNLIDAKKGQESDLILWLKQSKDNGIELFKANSDITDIDEALEHKSFKGWTTYFKGF
HENRKNVYSSNDIIIIYRIVDDNLPKPLENKAKYTISLKDKAPEAINYEQIKKDLAEELT
FDIDYKTSEVNQRVFSLDEVFEIANFNNYLNQSGITKFNTIIGGKFVNGENTKRKGINEYI
NLYSQQINDKTLKKYKMSVLFKQILSDTESKSFVIDKLEDDSDVVTTMQSFYEQIAAFKT
VEEKSIKETLSLLFDDLKAQKLDLSKIYFKNDKSLTDLSQQVFDDYSVIGTAVLEYITQQI
APKNLDNPSKKEQELIAKKTEKArCYLSLETIKLALEEFNKKRDIDKQCRFEEILANFAAIP
MIFDEIAQNKDNLAQISIKYQNQGKKDLLQASAEDDVKAIKDLLDQTNNLLHKLIGFH+
QSEDKANILDKDEHFYLVFEECYFELANIVPLYNKIRNYITQKPYSDEKFKLNFENSTLA
NGWDKNKEPDNTAILFIKDDKYYLGVNKKNNKIFDDKAIKENKGEGYKKIVYKLLPG
ANKMLPKVFFSAKSIKFYNPSEDILRIRNHSTHTKNGSPQKGYEKFEFNIEDCRKFIDFYK
QSISKIIPEWKDFGFRFSDTQRYNSIDEFYREVENQGYKLTFENISESYIDSVVNQGKLYL
FQIYNKDFSAYSKGRPNLHTLYWKALFDERNLQDVVYKLNGEAELFYRKQSIPKKITHP
AKEAIANKNKDNPKXESVFEYDUKDKRFTEDKFFFHCPITINFKSSGANKFNDEINLLLK
EKANDVHILSIDRGERHLAYYTLVDGKGNIIKQDTFNIIGRMKTNYHDKLAAIEKDR
DSARKDWKINNIKENfGYLQVVHEIAKLVIEYNAlVVFEDLNFGFKRGRFKVEKQV
YQKLEKMLIEKLNYLVFKDNEFDKTGGVLRAYQLTAPFETFKKMGKQTGIIYYVPAGFT
SKICPVTGFVNQLYPKYESVSKSQEFFSKFDKICYNLDKGYFEFSFDYKNFGDKAAKGK
WTIASFGSRLINFRNSDKNHNWDTREVYPTKELEKLLKDYSIEYGHGECIKAAICGESDK
```

-continued

```
KFFAKLTSVLNTILQMRNSKTGTELDYLISPVADVNGNFFDSRQAPKNMPQDADANGA
YHIGLKGLMLLGRIKNNQEGKKLNLVIKNEEYFEFVQNRNN (SEQ ID NO: 48)
```

Gene ID: H; Gene Type: Cpf1; Organism: *Francisella ularensis* subsp. *novicida*
U1I2; Spacer Length-mode (range): 31; DR1:
GUCUAAGAACUUUAAAUAAUUUCUACUGUUGUAGAU (SEQ ID NO: 49); DR2: none;
tracrRNA1:
AUCUACAAAAUUAUAAACUAAAUAAAGAUUCUUAUAAUAACUUUAUAUAUAAUC
GAAAUGUAGAGAAUUUU (SEQ ID NO: 50); tracrRNA2: none; Protein Sequence:

```
MSIYQEFVNKYSLSKTLRFELIPQGKTLENIKARGLILDDEKRAKDYKXAKQIIDKYHQF
FIEEILSSVCISEDLLQNYSDVYFKLKKSDDDNLQKDFKSAKDTIKKQISEYIKDSEKFKN
LFNQNLIDAKKGQESDLILWLKQSKDNGIELFKANSDITDIDEALEIIKSFKGWTTYFKGF
HENRKNVYSSNDIPTSIRYRIVDDNLPKFLENKAKYESLKDKAPEAINYEQIKKDL
FDIDYKTSEVNQRVFSLDEVFEIANFNNYLNQSGITKFNTNGGKFVNGENTKRKGINEYI
NLYSQQINDKTLKKYKMSVLFKQILSDTESKSFVIDKLEDDSDVVTTMQSFYEQIAAFKT
VEEKSIKETLSLLFDDLKAQKLDLSKIYFKNDKSLTDLSQQVFDDYSVIGTAVLEYITQQI
APKNLDNPSKKEQELIAKKTEKAKYLSLETIKLALEEFNKHRDIDKQCRFEEILANFAAIP
MIFDEIAQNKDNLAQISIKYQNQGKKDLLQASAEDDVKAIKDLLDQTNNLLHKLKIFHIS
QSEDKANLDKDEHFYLVFEECYFELANIVPLYNKIRNYITQKPYSDEKPKLNFENSTLA
NGWDKNKEPDNTAILFIKDDKYYLGVMNKKNNKIFDDKAIKENKGEGYKKIVYKLLPG
ANKMLPKVFFSAKSIKFYNPSEDILRIRNHSTHTKNGSPQKGYKFEFNIEDCRKFIDFYK
QSISKHPEWKDFGFRFSDTQRYNSIDEFYREVENQGYKLTFENISESYIDSVVNQGKLYL
FQIYNKDFSAYSKGRPNLHTLYWKALFDERNLQDVVYKLNGEAELFYRKQSIPKKTHP
AKEAIANKNKDNPKKESVFEYDLIKDKRFTEDKFFFHCPITINFKSSGANKFNDEINLLLK
EKANDVHILSIDRGERHLAYYTLVDGKGNIIKQDTFNIIGNDRMKTNYHDKLAAIEKDR
DSARKDWKKINNIKXMKEGYLSQWHEIAKLVIEYNAIVVFEDLNFGFKRGRFKVEVQV
YQKLEKMLIEKLNYLVFKDNEFDKTGGVLRAYQLTAPFETFKKMGKQTGIIYYVPAGFT
SKICPVTGFVNQLYPKYESVSKSQEFFSKFDKICYNLDKGYFEFSFDYKNFGDKAAKGK
WTIASFGSRLINFRNSDKNHNWDTREVYPTKELEKLLKDYSIEYGHGECIKAAICGESDK
KFFAKLTSVLNTILQMRNSKTGTELDYLISPVADVNGNFFDSRQAPKNMPQDADANGA
YHIGLKGLMLLGRIICNNQEGKKLNLVIKNEEYFEFVQNRNN (SEQ ID NO: 51)
```

Genes for Synthesis

For genes A through H, the Applicants optimize the genes for human expression and append the following DNA sequence to the end of each gene. Note this DNA sequence contains a stop codon (underlined), so no stop codon is added to the codon optimized gene sequence:

```
                                            (SEQ ID NO: 52)
AAAAGGCCGGCGGCCACGAAAAAGGCCGGCCAGGCAAAAAAGAAAAAGgg
atccTACCCATACGATGTTCCAGATTACGCTTATCCCTACGACGTGCCTG
ATTATGCATACCCATATGATGTCCCCGACTATGCCTAA
```

For optimization, avoid the following restriction sites: BamHI, EcoRI, HindIII, BsmBI, BsaI, BbsI, AgeI, XhoI, NdeI, NotI, KpnI, BsrGI, SpeI, XbaI, NheI These genes are cloned into a simple mammalian expression vector:

```
>A
MSLNRIYQGRVAAVETGTALAKGNVEWMPAAGGDEVLWQHHELFQAAINY
YLVALLALADKNNPVLGPLISQMDNPQSPYHVWGSFKKQGRQRTGLSQAVAPYITPGN
NAPTLDEVFRSILAGNPTDRATLDAALMQLLKACDGAGAIQQEGRSYWPKFCDPDSTA
NFAGDPAMLRREQHRLLLPQVLHDPAITHDSPALGSFDTYSIATPDTRTPQLTGPKARAR
LEQAITLWRVRLPESAADFDRLASSLKKIPDDDSRLNLQGYVGSSAKGEVQARLFALLL
FRHLERSSFTLGLLRSATPPPKNAETPPPAGVPLPAASAADPVRIARGKRSFVFRAFTSLP
CWHGGDNIHPTWKSFDIAAFKYALTVINQIEEKTKERQKECAELETDFDYMHGRLAKIP
VKYTTGEAEPPPILANDLRIPLLRELLQNIKVDTALTDGEAVSYGLQRRTIRGFRELRTTHW
RGHAPAGTVFSSELKEKLAGELRQFQTDNSTTIGSVQLFNELIQNPKYWPIWQAPDVETA
RQWADAGFADDPLAALVQEAELQEDIDALKAPVKLTPADPEYSRRQYDFNAVSKFGAG
SRSANRHEPGQTERGHNTFTTEIAARNAADGNRWRATHVRIHYSAPRLLRDGLRRPDTD
GNEALEAVPWLQPMMEALAPLPTLPQDLTGMPVFLMPDVTLSGERRILLNLPVTLEPAA
LVEQLGNAGRWQNQFFGSREDPFALRWPADGAVKTAKGKTHIPWHQDRDHFTVLGVD
LGTRDAGALALLNVTAQKPAKPVHRIIGEADGRTWYASLADARMIRLPGEDARLFVRG
KLVQEPYGERGRNASLLEWEDARNIILRLGQNPDELLGADPRRHSYPEINDKLLVALRR
AQARLARLQNRSWRLRDLAESDKALDEIHAERAGEKPSPLPPLARDDAIKSTDEALLSQ
RDIIRRSFVQlANLILPLRGRRWEWRPHVEVPDCHILAQSDPGTDDTKRLVAGQRGISM
RIEQIEELRRRCQSLNRALRHKPGERPVLGRPAKGEEIADPCPALLEKINRLRDQRVDQT
AHAILAAALGVRLRAPSKDRAERRHRDIHGEYERFRAPADFVVIENLSRYLSSQDRARSE
NTRLMQWCHRQIVQKLRQLCETYGIPVLAVPAAYSSRFSSRDGSAGFRAVHLTPDHRH
RMPWSRILARLKAHEEDGKRLEKTVLDEARAVRGLFDRLDRFNAGHVPGKPWRTLLAP
```

-continued

```
LPGGPVFVPLGDATPiMQADLNAAINIALRGlAAPDRHDIHHRLRAENKiQULSLRLGTQR
EKARWPGGAPAVTLSTPNNGASPEDSDALPERVSNLFVDIAGVANFERVTIEGVSQKFA
TGRGLWASVKQRAWNRVARLNETVTDNNRNEEEDDIPM (SEQ ID NO: 53)

>B
MATRSFILKJEPOTEVKKGLWKTHEVLNHGIAYYMNILKLIRQEAIYEHHEQD
PKNPKKVSKAEIQAELWDFVLKMQKCNSFTHEVDKDVVFNILRELYEELVPSSVEKKGE
ANQLSNKFLYPLVDPNSQSGKGTASSGRKPRWYNLKIAGDPSWEEEKKKWEEDKKKDP
LAKILGKLAEYGLIPLFIPFTDSNEPIVKEIKWMEKSRNQSVRRLDKDMFIQALERFLSWE
SWNLKVKEEYEKVEKEHKTLEERIKEDIQAFKSLEQYEKERQEQLLRDTLNTNEYRLSK
RGLRGWREIIQKWLKMDENEPSEKYLEVFKDYQRICHPREAGDYSVYEFLSKKENHFIW
RNHPEYPYLYATFCEIDKKKKDAKQQATFTLADPINHPLWVRFEERSGSNLNKYRILTE
QLHTEKLKKKLTVQLDRLIYPTESGGWEEKGKVDIVLLPSRQFYNQIFLDIEEKGKHAFT
YKDESIKFPLKGTLGGARVQFDRDHLRRYPHKVESGNVGRIYFNMTVNIEPTESPVSKSL
KIHRDDFPKFVWKPKELTEWIKDSKGKKLKSGIESLEIGLRVMSIDLGQRQAAAIIFEV
VDQKPDIEGKLFFPIKGTELYAVHRASFNIKLPGETLVKSREVLRKAREDNLKLMNQKL
NFLRNVLHFQQFEDITEREKRVTKWISRQENSDVPLVYQDELIQIRELMYKPYKDWVAF
LKQLHKRLEVEIGKEVKHWRKSLSDGRKGLYGISLKNIDEIDRTRKFLLRWSLRPTEPGE
VRRLEPGQRFAIDQLNHLNALKEDRLKKMANTIMMIIMHALGYCYDVRKKKWQAKNPACQI
ILFEDLSNYNPYEERSRFENSKLMKWSRREIPRQVALQGEIYGLQVGEVGAQFSSRFHAK
TGSPGIRCSVVTKEKLQDNRFFKNLQREGRLTLDKIAVLKEGDLYPDKGGEKFISLSKDR
KLVTTHADINAAQNLQKRFWTRTHGFYKVYCKAYQVDGQTVYIPESKDQKQKIIEEFG
EGYFILKDGVYEWGNAGKLKIBCKGSSKQSSSELVDSDILKDSFDLASELKGEKLMLYRD
PSGNVFPSDKWMAAGVFFGKLERILISKLTNQYSISTIEDDSSKQSM (SEQ ID NO: 54)

>C
MAIRSIKLKLKTHTGPEAQNLRKGIWRTHRLLNEGVAYYMKMLLLFRQESTG
ERPKEELQEELICHIREQQQRNQADKNTQALPLDKALEALRQLYELLVPSSVGQSGDAQI
ISRKFLSPLVDPNSEGGKGTSKAGAKPTWQKKKEANDPTWEQDYEKWKKRREEDPTAS
VITTLEEYGIRPIFPLYTNTVTDIAWLPLQSNQFVRTWDRDMLQQAIERLLSWESWNKRV
QEEYAKLKEKMAQLNEQLEGGQEWISLLEQYEENRERELRENMTAANDKYRITKRQM
KGWNELYELWSTFPASASHEQYKEALKRVQQRLRGRFGDAHFFQYLMEEKNRLIWKG
NPQRIHYFVARNELTKRLEEAKQSATMTLPNARKHPLWVRFDARGGNLQDYYLTAEAD
KPRSRRFVTFSQUWPSESGWMEKKDVEVELALSRQFYQQVKLLKNDKGKQKIEFKDK
GSGSTFNGHLGGAKLQLERGDLEKEEKNFEDGEIGSVYLNVVIDFEPLQEVKNGRVQAP
YGQVLQLIRRPNEFPKVTTYKSEQLVEWIKASPQHSAGVESLASGFRVMSIDLGLRAAA
ATSIFSVEESSDKNAADFSYWIEGTPLVAVHQRSYMLRLPGEQVEKQVMEKRDERFQLH
QRVFKQIRVLAQIMRMANKQYGDRWDELDSLKQAVEQKKSPLDQTDRTFWEGIVCDL
TKVLPRNEADWEQAVVQIHRKAEEYVGKAVQAWRKRFAADERKGIAGLSMWNIEELE
GLRKLLISWSRRTRNPQEVNRFERGHTSHQRLLTHIQNVKEDRLKQLSHAIVMTALGYV
YDERKQEWCAEYPACQVILFENLSQYRSNLDRSTKENSTLMKWAHRSIPKYVHMQAEP
YGIQIGDVRAEYSSRFYAKTGTPGIRCKKVRGQDLQGRRFENLQKRLVNEQFLTEEQVK
QLRPGDIVPDDSGELFNFFGNGSGSKEVWLQADWAAHNLQKRFWQRYNELFKVSCR
VIVRDEEEYLVPKTKSVQAKLGKGLFViCKSDTAWKDVYVWDSQAKLKGKTTFTEESES
PEQLEDFQEIIEEAEEAKGTYRTLFRDPSGVFFPESVWYPQKDFWGEVKRKLYGJCLRERF
LTKAR (SEQ ID NO: 55)

>D
MKISKVDHTRMAVAKGNQHRRDEISGILYKDPTKTGSIDQLLGAGGAKKLNCSAKI
LYHVRAGIAEGSNKYKNIVDKVNMLDRVLFTGKSYDRKSIIDIDTVLRNVEKINAFDRI
STEEREQIIDDLLEIQLRKGLRKGKAGLREVLLIGAGVIVRTDKKQEIADFLEILDEDFNK
TNQAKNIKLSIENQGLVVSPVSRGEERIFDVSGAQKGKSSKKAQEKEALSAFLLDYADL
DKNVRFEYLRKIRRLINLYFYVKNDDVMSLTEIPAEVNLEKDFDIWRDHEQRKEENGDF
VGCPDILLADRDVKKSNSKQVKIAERQLRESIREKNIKRYRFSIKTIEKDDGTYFFANKQI
SVFIHRIENAVERILGSINDKKLYRLRLGYLGEKVWKDILNFLSIKYIAVGKAVFNPAM
DDLQEKDRDIEPGKISENAVNGLTSFDYEQIKADEMLQREVAVNVAFAANNLARVTVDI
PQNGEKEDILLWNKSDIKKYKKNSKKGILKSILQFFGGASTWNMKMFEIAYHDQPGDYE
ENYLYDIIQIIYSLRNKSFHFKTYDHGDKNWNRELIGKMIEHDAERVISVEREKFHSNNLP
MFYKDADLKKILDLLYSDYAGRASQVPAFNTVLVRKNFPEFLRKDMGYKVHFNNPEVE
NQWHSAVYYLYKEIYYNLFLRDKEVKNLFYTSLKNIRSEVSDKKQKLASDDFASRCEEI
EDRSLPEICQIIMTEYNAQNFGNRKVKSQRVIEKNKDIFRHYKMLLIKTLAGAFSLYLKQ
ERFAFIGKATPIPYETTDVKNFLPEWKSGMYASFVEEIKNNLDLQEWYIVGRFLNGRML
NQLAGSLRSYIQYAEDIERRAAENRNKLFSKPDEKIEACKKAVRVLDLCIKISTRISAEFT
DYFDSEDDYADYLEKYLKYQDDAIKELSGSSYAALDHFCNKDDLKFDIYVNAGQKPIL
QRNIVMAKLFGPDNILSEVMEKVTESAIREYYDYLKKVSGYRVRGKCSTEKEQEDLLKF
QRLKNAVEFRDVTEYAEVINELLGQLISWSYLRERDLLYFQLGFHYMCLKNKSFKPAEY
VD1RRNNGTIIHNAILYQIVSMYINGLDFYSCDKEGKTLKPIETGKGVGSKIGQFIKYSQY
LYNDPSYKLEIYNAGLEVFENIDEHDNITDLRKYVDHFKYYAYGNKMSLLDLYSEFFDR
FFTYDMKYQKNVVNVLENILLRHFVIFYPKFGSGKKDVGIRDCKKERAQIEISEQSLTSE
DFMFKLDDKAGEEAKKFPARDERYLQTIAKLLYYPNEIEDMNRFMKKGETINKKVQFN
RKKKITRKQKNNSSNEVLSSTMGYLFKNIKL (SEQ ID NO: 56)

>E
MWISIKTLIHHLGVLFFCDYMYNRREKKIIEVKTMRITKVEVDRKKVLISRDK
NGGKLVYENEMQDNTEQIMHHKKSSFYKSVVNKTICRPEQKQMKKLVHGLLQENSQE
KIKVSDVTKLNISNFLNHRFKKSLYYPPENSPDKSEEYRIEINLSQLLEDSLKKQQGTFIC
WESFSKDMELYINWAENYISSKTKLIKKSIRNNRIQSTESRSGQLMDRYMKDILNKNK
DIQSVSEKYQLEKLTSALKATFKEAKKNDKEINYKLKSTLQNHERQIIEELKENSELNQF
NIEIRKHLETYFP1KKTNRKVGDIRNLEIGEIQKIVNHRLKNKIVQRILQEGKLASYEIESW
```

```
NSNSLQKIKIEEAFALKFINACLFASNNLRNMVYPVCKKDILMKIEFKNSFKEIKHKKFIR
QWSQFFSQEITVDDIELASWGLRGAIAPIRNEIIHLKKHSWKKFFNNPTFKVKKSKIINGK
TKDVTSEFLYKETLFKDYFYSELDSVPEUINKMESSKILDYYSSDQLNQVFTIPNFELSLL
TSAVPFAPSFKRVYLKGFDYQNQDEAQPDYNLKLNIYNEKAFNSEAFQAQYSLFKMVY
YQVFLPQFTTNNDLFKSSVDFILTLNKERKGYAKAFQDIRKMNKDEKPSEYMSYIQSQL
MLYQKKQEEKEKINHFEKFINQVFIKGFNSFIEKNRLTYICHPTKNTVPENDNIEIPFHTD
MDDSNIAFWLMCKLLDAKQLSELRNEMIKFSCSLQSTEEISTFTKAREV1GLALLNGEKG
CNDWKELFDDKEAWKKTMSLYVSEELLQSLPYTQEDGQTPVINRSIDLVKKYGTETILE
KLFSSSDDYKVSAKDIAKLHEYDVTEKIAWESLHKQWIEKPGLARDSAWTKKYQNVIN
DISNYQWAKTKVELTQVRHLQLTIDLLSRLAGYMSIADRDFQFSSNYILERENSEYRVT
SWILLSENKNKNKYNDYELYNLKNASIKVSSKhnDPQLKVDLKQLRLTLEYLELFDNTILK
EKRNNISHFNYLNGQLGNSILELFDDARDVLSYDRKLKNAVSKSLKEILSSHGMEVTFKP
LYQTNHHLKIDKLQPKKIHHLGEKSTVSSNQVSNEYCQLVRTLLTMK (SEQ ID NO: 57)

>F
MKVTKVDGISHKKYIEEGKLVKSTSEENRTSERLSELLSIRLDIYIKNPDNASE
EENRIRRENLKKFFSNKVLHLKDSVLYLKNRKEKNAVQDKNYSEEDISEYDLKNKNSFS
VLKKILLNEDVNSEELEIFRKDVEAKLNKINSLKYSFEENKANYQKINENNVEKVGGKS
KRNIIYDYYRESAKRNDYITTQQEAFDKLYKKEDIEICLFFLIENSKKHEKYKIREYYHKII
GRKNDKENFAKIIYEEIQNVNNIKELIEKIPDMSELKKSQVFYKYYLDKEELNDKNIKYA
FCHFVEIEMSQLLKNYVYKRLSNISNDKIKRIFEYQNLKKLIENKLLNKLDTYVRNCGKY
NYYLQVGEIATSDFIARNRQNEAFLRNIIGVSSVAYFSLRNILETENENDITGRMRGKTVK
NNKGEEKYVSGEVDKIYNENKQNEVKENLKMPYSYDRAMDNKNEIEDFFANIDEAISSI
RHGIVHFNLELEGKDIFAFKNIAPSEISKKMFQNEDSSSDKAMAAKDKLSLELEELEEM
VIIKYLKNTKFNFWKNIPFVPSFTKLYNKJEDLRNTLKFFWSVPKDKEEKIDAQIYLLKNI
YYGEFLNKFVKNSKWFKITNEVIKINKQRNQKTGHYKYQKFENIEAQQKQEEWSRRSLK
EMINNQDKEEKNTYIDFIQQIFLKGNIQKYTHLKNKVDGNELENELENELELAASKIS
KYDKJLKNYEKHNRNKEIPHEINEFVREIKLGKILKYTENLNMFYLILKLLNHKELTNLK
GSLEKYQSANKEETFSDELELINLLNLDNNRVTEDFELEANEIGKLFLFENENKIKDRKL
KKFDTNKIWDGENIIKHRAFYNIKKYGMLNLLEKIADKAKYXISLKELKEYSNKKNEIE
KNYTMQQNLHRKYARPKKDEKFNDEDYKEYEKAIGNIQKYTHLKNKVEFNELNLLQG
LLLKILHRLVGYTSIWERDLRFRLKGEFPENHYIEEIFNFDNSKNVKYKSGQIVEKYINFY
KELYKDNVEKRSIYSDKKVKKLKQEKKDLYIRNYIAHFNYIPHAEISLLEVLENLRKLLS
YDRKLKNAIMKSIVDILKEYGFVATPKIGADKKIEIQTLESEKIVHLKNLKKKKLMTDRN
SEELCELVKVMFEYKALE (SEQ ID NO: 58)

>G
MGNLFGHKRWYEVRDKKDFKIKRKVKVKRNYDGNKYILNINENNNKEKID
NNKFIRKYINYKKNDNILKEFTRKFHAGNILFKLKGKEGIRRIENNDDFLETEEVVLYIEA
YGKSEKLKALGITKKKIIDEAIRQGITKDDKKIEIKRQENEEEIEIDIRDEYTNKTLNDCSII
LRIIENDELETKKSIYEIFKTINMSLYKIIEKIIENETEKVFENRYYEEHLREKLLKDDKJDV
ILTNFMEIREKIKSNLEILGFVKFYLNVGGDKKKSKNKKMLVEKILNINVDLTVEDIADF
VIKELEFWMTKRIEKVKKVNNEFLEKRRNRTYIFAAKIKKLLKSAALEREEANNMNNTHAL
FVENIKNNSIKEKIEKILAEFKIDELIKKLEKEKELKKGNCDTEIFGIFKKHYKVNFDSKKFSK
KSDEEKELYKIIYRYLKGRIEKILVNEQKVRLKKMEKIEIEKILNESIIEKILKRVDFFFG
EHIMYLGKLRHNDIDMTTVNTDDFSRLHAKEELDLELITFFASTNMELNIGFSRENINFFFAA
ENIDFFGGDREKNYVLDKKILNSKIKIIRDLDFIDNICNNITNNFIRKFTKIGTNERNRILHAI
SKERDLQGTQDDYNKVINIIQNLKISDEEVSKALNLDVVFKDKKNIITKINDIKISEENNN
DIKYLPSFSKVLPEILNLYRNNPKNEPFDTIETEKIVLNALIYVNKELYKKLILEDDLEENE
SKMFLQELKKTLGNIDEIDENIIENYYKNAQISASKGHQNNKCAIKKYQKKVIECYIGYLRKN
YEELFDFSDFKMMQEKKQIKDINDNKTYERITVKTSDKTIVINDDFEYIISIFALLNSNAV
INKIRNRFFATSVWLNTSEYQNIIDILDEIMQLNTLRNECITENWNLNLEEFIQICMKEIEKD
FDDDFKIQTKKEIFNNYYEDIKNNILTEFKDDINGCDVLEKKLEKIVIFDDETKFEIDKKSNJ
LQDEQRKLSNINKKDLKKKVDQYIKDKDQEIKSKILCRIIFNSDFLKKYKKEIDNLIEDME
SENENKFQEIYYPKERKNELYIYKKNLFLNIGNPNFDKIYGLISNDIKMADAKFLFNIG
NIRKNKISEIDAILKLNLNDKLNGYSKEYKEKYIKKLKENDDFFAKNIQNKNYKSFEKDYN
RVSEYKKIRDLVEFNYLNKIESYLIDINWKLAIQMARFERDMHYIVNGLRELGIIKLSGY
NTGISRAYPKRNGSIXJFYTTTAYYKFFDEESYKKFEKICYGFGIDLSENSEINKPENESIR
NYISHFYIVRNPFADYSIAEQIDRVSNLIYSTRYNNSTYASVFEVFKKDWLDYDELKK
KPKLIGNNDILERLMKPKKVSVLELESYNSDYIIGLIIELLTKIENTQDTL (SEQ ID NO: 59)

>H
MSIYQEFVNKYSIKTLRFELIPQGKTLENIKARGLILDDEKRAKDYKKAKQIIKQI
DKYHQFFIEEILSSVCISEDLLQNYSDVYFKLKKSDDDNLQKDFKSAKDTIKKQISEYIKD
SEKFKNLFNQNLIDAKKGQESDLILWLKQSKDNGIELFKANSDITDIDEALEIIKSFKGWT
TYFKGFHENRKNVYSSNDIPTSIIYR1VDDNLPKFLENKAKYESLKDKAPEAINYEQIKKD
LAEELTFDIDYKTSEWQRVFSLDEVFEIANFNNYLNQSG1TKFNTIIGGKPVNGENTKRK
GINEYINLYSQQINDKTLKKYKMSVLFKQILSDTESKSFVIDKLEDDSDVVTTMQSFYEQI
AAFKTVEEKSIKETLSLLFDDLKAQKLDLSKIYFKNDKSLTDLSQQVFDDYSVIGTAVLE
YITQQIAPKNLDNPSKKEQELIAKKTEKAKYLSLETIKLALEEFNKHRDIDKQCRFEEILA
NFAAIPMIFDEIAQNKDNLAQISIKYQNKKDLLQASAEDDVKAIKDLLDQTNNLLHK
LKIFHISQSEDKANILDKDEHFYLVFEECWELANIVPLYNKIRNMQKPYSDEKFKLNFE
NSTLANGWDKNKEPDNTAILFIKDDKYYLGVMLQASAEDDVKAIKDLLDQTKGYEKFEF
KLLPGANKMLPKVFFSAKSIKFYNPSEDILRIRNHSTHTKNGSPQKGYEKFEFNIEDCRKF
IDFYKQSISKHPEWKDFGFRFSDTQRYNSIDEFYREVENQGYKLTFENISESYIDSVVNQG
KLYLFQIYNKDFSAYSKGRPNLVVYKLNGEAELFYRKQSIPKIDEFYREVENQGY
KITHPAKEAIANKNDPKKESWEYDLTCHTLYWKALFDERNLQDLTFENIVENQGYKLTF
NLLLLEKANDVHILSIDRGERH1AYYTLVIXKGNKQDTFNIIGNDRMKTNYHDKLAAI
```

-continued

EKDRDSARKDWKKINNIKEMKEGYLSQVVHEIAKLVIEYNAIWFEDLNFGFKRGRFKV
EKQVYQKLEKMLIEKLNYLVFKDNEFDKTGGVLRAYQLTAPFETFKKMGKQTGIIYYV
PAGFTSKJCPVTGFVNQLYPKYESVSKSQEFFSKFDKICYNLDKGYFEFSFDYKNFGDKA
AKGKWTIASFGSRLINFRNSDKNHNWDTREVYPTKELEKLLKDYSIEYGHGECIKAA1C
GESDKKFFAKLTSVLNTII+MRNSKTGTELDYLISPVADVNGNFFDSRQAPKNMPQDAD
ANGAYHIGLKGLMLLGRKNNQEGKKLNLVIKNEEYFEFVQNRNN (SEQ ID NO: 60)

A-locus through G-locus are cloned and inserted into a low-copy plasmid. A vector that does not contain Amp resistance is used.

```
>A-locus
TATCCGGTCGAATCGAGAATGACGACCGCTACGTCTTGGACTACGAAGCC
GTGGCCCTTGCCGATGCTCTCGGTGTGGATQTTGCCGACCTGTTCCGCAAGATCGAT
TGCCCCAAGAACCTGCTGCGCAGGCGGGCAGGGTAGGGGAGCGGTTTCCGGCGGAG
ATTTTCGGAGGCGCCGGTAACGTTATGTCGGGGAATTTGCTATACATCGACGATAAT
TAGTTTTGYTGATTCAGGATCGAAATGCGCTCAAACAAAGAACGTTCCGCGTTTCCC
TCATGCGCTACTACGCCCACACCGCCATCTTTCGGCACGCAAACAAAGCAGATGGGT
TGCCTGTCAATGGGTGATCATTGCCTGAAGTTACCATCCATCAATAATATAAATCAT
CCTTACTCCGAATGTCCCTCAATCGCATCTATCAAGGCCGCGTGGCGGCCGTCGAAA
CAGGAACGGCCTTAGCGAAAGGTAATGTCGAATGGATGCCTGCCGCAGGAGGCGAC
GAAGTTCTCTGGCAGCATTACGAACTTTTCCAAGCTGCCATCAACTACTATCTCGTC
GCCCTGCTCGCACTCGCCGACAAAAACAATCCCGTACTTGGCCCGCTGATCAGCCAG
ATGGATAATCCCCAAAGCCCTTACCATGTCTGGGGAAGTTTCCGCCGCCAAGGACGT
CAGCGCACAGGTCTCAGTCAAGCCGTTGCACCTTATATCACGCCGGGCAATAACGCT
CCCACCCTTGACGAAGTTTTCCGCTCCATTCTTGCGGGCAACCCAACCGACCGCGCA
ACTTTGGACGCTGCACTCATGCAATTGCTCAAGGCTTGTGACGGCGCGGGCGCTATC
CAGCAGGAAGGTCGTTCCTACTGGCCCAAATTCTGCGATCCTGACTCCACTGCCAAC
TTCGCGGGAGATCCGGCCATGCTCCGGCGTGAACAACACCGCCTCCTCCYTCCGCAA
GTTCTCCACGATCCGGCGATTACTCACGACAGTCCTGCCCTTGGCTCGTTCGACACTT
ATTCGATTGCTACCCCCGACACCAGAACTCCTCAACTCACCGGCCCCAAGGCACGCG
CCCGTCTTGAGCAGGCGATCACCCTCTGGCGCGTCCGTCTTCCCGAATCGGCTGCTG
ACTTCGArCGCCTTGCCAGTTCCCTCAAAAAAATTCCGGACGACGATTCTCGCCTTA
ACCTTCAGGGCTACGTCGGCAGCAGTGCGAAAGGCGAAGTrCAGGCCCGTCTTTTCG
CCCTTCTGCTATTCCGTCACCTGGACCGTTCCTCCTTTACGCTTGGCCTTCTCCGTTCC
GCCACCCCGCCGCCCAAGAACGCTGAAACACCTCCTCCCGCCGGCGTTCCTTTACCT
GCGGCGTCCGCAGCCGATCCGGTGCGGATAGCCCGTGGCAAACGCAGTTTTGTTTTT
CGCGCATTCACCAGTCTCCCCTGCTGGCATGGCGGTGATAACATCCATCCCACCTGG
AAGTCATTCGACATCGCAGCGTTCAAATATGCCCTCACGGTCATCAACCAGATCGAG
GAAAAGACGAAAGAACGCCAAAAAGAATGTGCGGAACTTGAAACTGATITCGACTA
CATGCACGGACGGCTCGCCAAGATTCCGGTAAAATACACGACCGGCGAAGCCGAAC
CCTCCCCCCATTCTCGCAAACGATCTCCGCATCTTGGTCACCTGAAACCCTGTCCTC
ATATCAAGGTCGACACCGCACTCACCGATGGCGAAGCCGTCTCCTATGGTCTCCAAC
GCCGCACCATTCGCGGTTTCCGCGAGCTGCGCCGCATCTGGCGCGGCCATGCCCCCG
CTGGCACGGTCTTTTCCAGCGAGTTGAAAGAAAAACTAGCCGGCGAACTCCGCCAG
TTCCAGACCGACAACTCCACCACCATCGGCAGCGTCCAACTCTTCAACGAACTCATC
CAAAACCCGAAATACTGGCCCATCTGGCAGGCTCCTGACGTCGAAACCGCCCGCCA
ATGGGCCGATGCCGGTTTTGCCGACGATCCGCTCGCCGCCCTTGTGCAAGAAGCCGA
ACTCCAGGAAGACATCGACGCCCTCAAGGCTCCAGTCAAACTCACTCCGGCCGATC
CTGAGTATTCAAGAAGGCAATACGATTTCAATGCCGTCAGCAAATTCGGGGCCGGCT
CCCGCTCCGCCAATCGCCACGAACCCGGGCAGACGGAGCGCGGCCACAACACCTTT
ACCACCGAAATCGCCGCCCGTAACGCGGCGGACGGGAACCGCTGGCGGGCAACCCA
CGTCCGCATCCATrACTCCGCTCCCCGCCTTCTTCGTGACGGACTCCGCCGACCTGAC
ACCGACGGCAACGAAGCCCTGGAAGCCGTCCCTTGGCTCCAGCCCATGATGGAAGC
CCTCGCCCCTCTCCCGACGCTTCCGCAAGACCTCACAGGCATGCCGGTCTTTCCTCAT
GCCCGACGTCACCCTTTCCGGTGAGCGTCGCATCCTCCTCAATCTTCCTGTCACCCTC
GAACCAGCCGCTCTTGTCGAACAACTGGGCAACGCCGGTCGCTGGCAAAACCAGTT
CTTCGGCTCCCGCGAAGATCCATTCGCTCTCCGATGGCCCGCCGACGGTGCTGTAAA
AACCGCCAAGGGGAAAACCCACATACCTTGGCACCAGGACCGCGATCACTTCACCG
TACTCGGCGTGGATCTCGGACACGCGCGATGCCGGGGCGCTCGCTCTTCTCAACGTCA
CTGCGCAAAAACCGGCCAAGCCGGTCCACCGCATCATTGGTGAGGCCGACGGACGC
ACCTGGTATGCCAGCCTTGCCGACGCTCGCATGATCCGCCTGCCCGGGGAGGATGCC
CGGCTCTTTGTCCGGGGAAAACTCGTTCAGGAACCCTATGGTGAACGCCGGCGAAA
CGCGTCTCTTCTCGAATGGGAAGACGCCCGCAATATCATCCTTCGCCTTGGCCAAAA
TCCCGACGAACTCCTCGGCGCCGATCCCCGGCGCCATTCGTATCCGGAAATAAACGA
TAAACTTCTCGTCGCCCTTCGCCGCGCTCAGGCCCGTCTTGCCCGTCTCCAGAACCG
GAGCTGGCGGTTGCGCGACCTTGCAGAATCGGACAAGGCCCTTGATGAAATCCATG
CCGAGCGTGCCGGGGAGAAGCCTTCTCCGCTTCCGCCCTTGGCTCGCGACGATGCCA
TCAAAAGCACCGACGAAGCCCTCCTTTCCCAGCGTGACATCATCCGGCGATCCTTCG
TTCAGATCGCCAACTTGATCCTTCCCCTTCGCGGACGCCGATGGGAATGGCGGCCCC
ATGTCGAGGTCCCGGATTGCCACATCCTTGCGCAGAGCGATCCGGTACGGATGAC
ACCAAGCGTCTTGTCGCCGGACAACGCGGCATCTCTCACGAGCGTATCGAGCAAAT
CGAAGAACTCCGTCGTCGCTGCCAATCCCTCAACCGTGCCCTGCGTCACAAACCCGG
AGAGCGTCCCGTGCTCGGACGCCCCGCCAAGGGCGAGGAAATCGCCGATCCCTGTC
CCGCGCTCCTCGAAAAGATCAACCGTCTCCGGGACCAGCGCGTTGACCAAACCGCG
CATGCCATCCTCGCCGCGCTCTCGGTGTTCGACTCCGCGCCCCCTCAAAAGACCGC
GCCGAACGCCGCCATCGCGACATCCATGGCGAATACGAACGCTTTCGTGCGCCCGCT
```

-continued
```
GATTTTGTCGTCATCGAAAACCTCTCCCGTTATCTCAGCTCGCAGGATCGTGCTCGTA
GTGAAAACACCCGTCTCATGCAGTGGTGCCATCGCCAGATCGTGCAAAAACTCCGTC
AGCTCTGCGAGACCTACGGCATCCCCGTCCTCGCCGTCCCGGCGGCCTACTCATCGC
GTTTTTCTTCCCGGGACGGCTCGGCCGGATTCCGGGCCGTCCATCTGACACCGGACC
ACCGTCACCGGATGCCATGGAGCCGCATCCTCGCCCGCCTCAAGGCCCACGAGGAA
GACGGAAAAAGACTCGAAAAGACGGTGCTCGACGAGGCTCGCGCCGTCCGGGGACT
CTTTGACCGGCTCGACCGGTTCAACGCCGGGCATGTCCCGGGAAAACCTTGGCGCAC
GCTCCTCGCGCCGCTCCCCGGCGGCCCTGTGTTTGTCCCCCTCGGGGACGCCACACC
CATGCAGGCCGATCTGAACGCCGCCATCAACATCGCCCTCCGGGGCATCGCGGCTCC
CGACCGCCACGACATCCATCACCGGCTCCGTGCCGAAAACAAAAAACGCATCCTGA
GCTTGCGTCTCGGCACTCAGCGCGAGAAAGCCCGCTGGCCTGGAGGAGCTCCGGCG
GTGACACTCTCCACTCCGAACAACGGCGCCTCTCCCGAAGATTCCGATGCGTTGCCC
GAACGGGTATCCAACCTGTTTGTGGACATCGCCGGTGTCGCCAACTTCGAGCGAGTC
ACGATCGAAGGAGTCTCGCAAAAATTCGCCACCGGGCGTGGCCTTTGGGCCTCCGTC
AAGCAACGTGCATGGAACCGCGTTGCCAGACTCAACGAGACAGTAACAGATAACAA
CAGGAACGAAGAGGAGGACGACATTCCGATGTAACCATTGCTTCATTACATCTGAG
TCTCCCCTCAATCCCTCTGCCCCATGCGTGATATAACCTCCACCTCATGTCCCGGATC
GGCGCCGGCAACCTGTAGTTCCCTTCCATCCTCCAACACTCCCGCAGATCGCGATCC
GCTGCCGCCGATGCCGGTGCGCCGCCTTCACAACTATCTCTACTGTCCGCGGCTTTTT
TATCTCCAGTGGGTCGAGAATCTCTTTGAGGAAAATGCCGACACCATTGCCGGCAGC
GCCGTGCATCGTCACGCCGACAAACCTACGCGTTACGATGATGAAAAAGCCGAGGC
ACTTCGCACTGGTCTCCCTGAAGGCGCGCACATACGCAGCCTTCGCCTGGAAAACGC
CCAACTCGGTCTCGTTGGCGTGGTGGATATCGTGGAGGGAGGCCCCGACGGACTCG
AACTCGTCGACTACAAAAAAGGTTCCGCCTTCCGCCTCGACGACGGCACGCTCGCTC
CCAAGGAAAACGACACCGTGCAACTTGCCGCCTACGCTCTTCTCCTGGCTGCCGATG
GTGCGCGCGTTGCGCCCATGGCGACGGTCTATTACGCTGCCGATCGCCGGCGTGTCA
CCTTCCCGCTCGATGACGCCCTCTACGCCCGCACCCGTTCCGCCCTCGAAGAGGCCC
GCGCCGTTGCAACCTCGGGGCGCATACCTCCGCCGCTCGTCTCTGACGTCCGCTGCC
TCCATTGTTCCTCCTATGCGCTTTGCCTTCCCCGCGAGTCCGCCTGGTGGTGCCGCCA
TCGCAGCACGCCGCGGGGAGCCGGCCACACCCCATGTTGCCGGGCTTTGAGGATG
ACGCCGCCGCCATTCACCAAATCTCCGAACCTGACACCGAGCCACCACCCGATCTTG
CCAGCCAGCCTCCCCGTCCCCGCGGCTCGATGGAGAATTGTTGGTTGTCCAGACTC
CGGGAGCGATGATCGGACAAAGCGGCGGTGAGTTTACCGTGTCCGTCAAGGGTGAG
GTTTTGCGCAAGCTTCCGGTTCATCAACTCCGGGCCATTTACGTTTACGGAGCCGTG
CAACTCACGGCGCATGCTGTGCAGACCGCCCTTGAGGAGGATATCGACGTCTCCTAT
TTTGCGCCCAGCGGCCGCTTTCTTGGCCTCCTCCGCGGCCTGCCCGCATCCGGCGTG
GATGCGCGTCTCGGGCAATACACCCTGTTTCGCGAACCCTTTGGCCGTCTCCGTCTC
GCCTGCGAGGCGATTCGGGCCAAGATCCATAACCAGCGCGTCCTCCTCATGCGTAAC
GGCGAGCCCGGGGAGGGCGTCTTGCGCGAACTCGCCCGTCTGCGCGACGCCACCAG
TGAGGCGACTTCGCTCGACGAACTCCTCGGCATCGAGGGCATCGCCGCGCATTTCTA
TTTCCAGTATTTTCCCACCATGCTGAAAGAACGGGCGGCCTGGGCCTTTGATTTTT
GGACGCAATCGCCGCCCGCCGCGCGACCCGGTCAACGCCCTGCTTTCGTTCGGTTAC
AGCGTGTTGTCCAAGGAACTTGCCGGCGTCTGCCACGCTGTTGGCCTAGACCCGTTT
TTCGGCTTCATGCACCAGCCGCGTTACGGGCGCCCCGCACTCGCTCTCGATCTGATG
GAGGAGTTTCGCCCTCTCATCGCCGACAGTGTTGCCCTGAATCTCATCAACCGTGGC
GAACTCGACGAAGGGGACTTTATCCGGTCGGCCAATGGCACCGCGCTCAATGATCG
GGGCCGCCGGCGTTTTTGGGAGGCATGGTTCCGGCGTCTCGACAGCGAAGTCAGCC
ATCCTGAATTTGGTTACAAGATGAGCTATCGACGGATGCTTGAAGTGCAGGCGCGCC
AGCTATGGCGCTATGTGCGCGGTGACGCCTTCCGCTACCACGGATTCACCACCCGTT
GATTCCGATGTCAGATCCCCGCCGCCGTTATCTTGTGTGTTACGACATCGCCAATCC
GAAGCGATTGCGCCAAGTGGCCAAGCTCCTGGAGAGCTATGGCACGCGTCTGCAAT
ACTCGGTTTTCGAATGTCCTTTGGACGATCTTCGTCTTGAACAGGCGAAGGCTGATTT
GCGCGACACGATTAATGCCGACCAAGACCAGGTGTTATTTGTTTCGCTTGGCCCCGA
AGCCAACGATGCCACGTTGATCATCGCCACGCTTGGGCTCCCTTATACCGTGCGCTC
GCGAGTGACGATTATCTGACCCATAACCCACGTGTTGAAGAGGCTGAAAACAGACG
GACCTCTATGAAGAACAATTGACGTTTTGGCCGAACTCAGCAGACCTTTATGCGGCT
AAGGCCAATGATCATCCATCCTACCGCCATTGGGCTGGAGACGTTTTTTGAAACGGC
GAGTGCTGCGGATAGCGAGTTTCTCTTGGGGAGGCGCTCGCGGCCACTTTTACAGAG
GAGATGTTCGGGCGAACTGGCCGACCTAACAAGGCGTACCCGGCTCAAAATCGAGG
CACGCTCGCACGGGATGATGTAATTCGTTGTTTTTCAGCATACCGTGCGAGCACGGG
CCGCAGCGAATGCCGTTTCACGAATCGTCAGGCGGCGGGGAGAAGTCATTTAATAA
GGCCACTGTTAAAAGCCGCAGCGAATGCCGTTTCACGAATCGTCAGGCGGGCAGTG
GATGTTTTTCCATGAGGCGAAGAATTTCATCGCCGCAGTGAATGCCGTTTCACCATT
GATGAAGAATGCGAGGTGAAAACAGAGAATTGGGTCAACTCTATCACTCTTATTC
AGCCATCGTTTCAAGAAAGGATACCTCGTATTGGATACAACACAGCTCGTTCGTTCT
CTCTACCTCCCTCGACAATCTCAAGGA (SEQ ID NO: 61)

>B-Locus
TAATAAAATTGAAATATCACTATGGATTATTGTAATATTACCATAAAGAT
AGGTGACGTTTTTTGAAAATTGTAAACCTAATTTGAAGAAAACCAATTAAAAATCG
CTTCGGCTTTTTTTTAAGTGCCAGGTAGCATTGATGCTAACCCATGTGTAATAAAGGT
TTGTTTTCCTTCGGGGCACGAACACATTATAAGGGAAACCTAAAGATTCCCTTTCTT
GTTTAATATTATAACCAGTGAAAATAAGAATAATGCACCTAAAACTAATATACAGA
AAATAAGAATTAAAAGTACTAATATATACATCATATGTTATCCTCCAATGCTTTATTT
TTTAATAATTGATGTTAGTATTAGTTTTATTTTAATTTCTAAACATAAGAATTTG
AGGATGTGTTTATTATGGCGACACGCAGTTTTATTTTAAAAATTGAACCAAATGAAG
AAGTTAAAAAGGGATTATGGAAGACGCATGAGGTATTGAATCATGGAATTGCCTAC
TACATGAATATTCTGAAACTAATTAGACAGGAAGCTATTTATGAACATCATGAACAA
GATCCTAAAAATCCGAAAAAAGTTTCAAAAGCAGAAATACAAGCCGAGTTATGGGA
TTTTGTTTTAAAAATGCAAAAATGTAATAGTTTTACACATGAAGTTGACAAAGATGT
TGTTTTTAACATCCTGCGTGAACTATATGAAGAGTTGGTCCCTAGTTCAGTCGAGAA
```

-continued

```
AAAGGGTGAAGCCAATCAATTATCGAATAAGTTTCTGTACCCGCTAGTTGATCCGAA
CAGTCAAAGTGGGAAAGGGACGGCATCATCCGGACGTAAACCTCGGTGGTATAATT
TAAAAATAGCAGGCGACCCATCGTGGGAGGAAGAAAAGAAAAAATGGGAAGAGGA
TAAAAAGAAAGATCCCCTTGCTAAAATCTTAGGTAAGTTAGCAGAATATGGGCTTAT
TCCGCTATTTATTCCATTTACTGACAGCAACGAACCAATTGTAAAAGAAATTAAATG
GATGGAAAAAAGTCGTAATCAAAGTGTCCGGCGACTTGATAAGGATATGTTTATCC
AAGCATTAGAGCGTTTTCTTTCATGGGAAAGCTGGAACCTTAAAGTAAAGGAAGAG
TATGAAAAAGTTGAAAAGGAACACAAAACACTAGAGGAAAGGATAAAAGAGGACA
TTCAAGCATTTAAATCCCTTGAACAATATGAAAAAGAACGGCAGGAGCAACTTCTTA
GAGATACATTGAATACAAATGAATACCGATTAAGCAAAAGAGGATTACGTGGTTGG
CGTGAAATTATCCAAAAATGGCTAAAGATGGATGAAAATGAACCATCAGAAAAATA
TTTAGAAGTATTTAAAGATTATCAACGGAAACATCCACGAGAAGCCGGGGACTATT
CTGTCTATGAATTTTTAAGCAAGAAAGAAAATCATTTTATTTGGCGAAATCATCCTG
AATATCCTTATTTGTATGCTACATTTTGTGAAATTGACAAAAAAAGAAAAGACGCTA
AGCAACAGGCAACTTTTACTTTGGCTGACCCGATTAACCATCCGTTATGGGTACGAT
TTGAAGAAAGAAGCGGTTCGAACTTAAACAAATATCGAATTTTAACAGAGCAATTA
CACACTGAAAAGTTAAAAAGAAATTAACAGTTCAACTTGATCGTTTAATTTATCCA
ACTGAATCCGGCGGTTGGGAGGAAAAAGGTAAAGTAGATATCGTTTTGTTGCCGTC
AAGACAATTTTATAATCAAATCTTCCTTGATATAGAAGAAAAGGGGAAACATGCTTT
TACTTATAAGGATGAAAGTATTAAATTCCCCCTTAAAGGTACACTTGGTGGTGCAAG
AGTGCAGTTTGACCGTGACCATTTGCGGAGATATCCGCATAAAGTAGAATCAGGAA
ATGTTGGACGGATTTATTTTAACATGACAGTAAATATTGAACCAACTGAGAGCCCTG
TTAGTAAGTCTTTGAAAATACATAGGGACGATTTCCCCAAGTTCGTTAATTTTAAAC
CGAAAGAGCTCACCGAATGGATAAAAGATAGTAAAGGGAAAAAATTAAAAAGTGG
TATAGAATCCCTTGAAATTGGTCTACGGGTGATGAGTATCGACTTAGGTCAACGTCA
AGCGGCTGCTGCATCGATTTTTGAAGTAGTTGATCAGAAACCGGATATTGAAGGGA
AGTTATTTTTTCCAATCAAAGGAACTGAGCTTTATGCTGTTCACCGGGCAAGTTTTAA
CATTAAATTACCGGGTGAAACATTAGTAAAATCACGGGAAGTATTGCGGAAAGCTC
GGGAGGACAACTTAAAATTAATGAATCAAAAGTTAAACTTTCTAAGAAATGTTCTAC
ATTTCCAACAGTTTGAAGATATCACAGAAAGAGAGAAGCGTGTAACTAAATGGATT
TCTAGACAAGAAAATAGTGATGTTCCTCTTGTATATCAAGATGAGCTAATTCAAATT
CGTGAATTAATGTATAAACCCTATAAAGATTGGGTTGCCTTTTTAAAACAACTCCAT
AAACGGCTAGAAGTCGAGATTGGCAAAGAGGTTAAGCATTGGCGAAAATCATTAAG
TGACGGGAGAAAAGGTCTTTACGGAATCTCCCTAAAAAATATTGATGAAATTGATC
GAACAAGGAAATTCCTTTTAAGATGGAGCTTACGTCCAACAGAACCTGGGGAAGTA
AGACGCTTGGAACCAGGACAGCGTTTTGCGATTGATCAATTAAACCACCTAAATGCA
TTAAAAGAAGATCGATTAAAAAAGATGGCAAATACGATTATCATGCATGCCTTAGG
TTACTGTTATGATGTAAGAAAGAAAAAGTGGCAGGCAAAAAATCCAGCATGTCAAA
TTATTTTATTTGAAGATTTATCTAACTACAATCCTTACGAGGAAAGGTCCCGTTTTGA
AAACTCAAAACTGATGAAGTGGTCACGGAGAGAAATTCCACGACAAGTCGCCTTAC
AAGGTGAAATTTACGGATTACAAGTTGGGGAAGTAGGTGCCCAATTCAGTTCAAGA
TTCCATGCGAAAACCGGGTCGCCGGGAATTCGTTGCAGTGTTGTAACGAAAGAAAA
ATTGCAGGATAATCGCTTTTTTAAAAATTTACAAAGAGAAGGACGCTTACTCTTGA
TAAAATCGCAGTTTTAAAAGAAGGAGACTTATATCCAGATAAAGGTGGAGAAAAGT
TTATTTCTTTATCAAAGGATCGAAAGTTGGTAACTACGCATGCTGATATTAACGCGG
CCCAAAATTTACAGAAGCGTTTTTGGACAAGAACACATGGATTTTATAAAGTTTACT
GCAAAGCCTATCAGGTTGATGGACAAACTGTTTATATTCCGGAGAGCAAGGACCAA
AAACAAAAAATAATTGAAGAATTTGGGGAAGGCTATTTTATTTTAAAAGATGGTGT
ATATGAATGGGTAATGCGGGGAAACTAAAAATTAAAAAAGGTTCCTCTAAACAAT
CATCGAGTGAATTAGTAGATTCGGACATACTGAAAGATTCATTTGATTTAGCAAGTG
AACTTAAGGGAGAGAAACTCATGTTATATCGAGATCCGAGTGGAAACGTATTTCCTT
CCGACAAGTGGATGGCAGCAGGAGTATTTTTTGGCAAATTAGAAAGAATATTGATTT
CTAAGTTAACAAATCAATACTCAATATCAACAATAGAAGATGATTCTTCAAAACAAT
CAATGTAAAAGTTTGCCCGTATAAGAACTTAATTAATTAGGATGGTAGGATGTTACT
AAATATGTCTGTAGGCATCATTCCTACTATCCGTTTTGTCCGAATATCAGAGCATTAG
GTGAGGAATGGTAAGAAAGGAAAATTTATATGAACCAACCGATTCCTATTCGAATG
TTAAATGAAATACAATATTGTGAGCGACTTTTTTACTTTATGCATGTCCAAAAGCTAT
TTGATGAGAATGCAGATACAGTTGAAGGAAGTGCACAGCATGAGCGGGCAGAAAG
AAGCAAAAGACCAAGTAAAATGGGACCAAAGGAATTATGGGGTGAGGCGCCAAGA
AGTCTTAAGCTTGGTGATGAGCTGTTAAATATTACCGGTGTTCTTGATGCCATAAGT
CATGAAGAGAACAGTTGGATCCCGGTTGAATCAAAACACAGTTCCGCACCGGATGG
ATTGAACCCTTTTAAAGTAGATGGCTTTCTACTTGACGGGTCTGCATGGCCAAACGA
TCAAATTCAACTTTGTGCACAAGGCTTGCTCTTGAATGCCAATGGATACCCGTGTGA
TTATGGGTATTTATTTTATCGTGGTAATAAGAAAAAGGTGAAAATTTATTTTACTGA
AGATTTAATCGCTGCCACAAAGTACTATATTAAAAAAGCACACGAGATACTAGTATT
ATCTGGTGATGAATCAGCTATTCCTAAGCCTTTAATTGATTCTAATAAGTGTTTTCGC
TGTTCTTTAAACTATATCTGTCTTCCGGATGAAACGAACTATCTATTAGGGGCAAGTT
CAACAATTCGTAAAATTGTGCCTTCAAGGACAGATGGTGGCGTTTTATATGTATCAG
AGTCTGGTACAAAATTAGGAAAATCGGGTGAGGAGTTAATCATTCAGTATAAAGAT
GGCCAAAAGCAGGGTGTTCCTATAAAAGATATTATTCAAGTTTCGTTAATTGGAAAT
GTTCAATGCTCAACGCAATTACTTCATTTTTTAATGCAATCAAATATTCCTGTAAGTT
ATTTATCATCCCACGGTCGTTTGATTGGTGTCAGTTCATCTTTAGTTACAAAAAATGT
TTTAACAAGGCAGCAACAGTTCATTAAATTTACAAATCCTGAGTTTGGACTAAATCT
AGCAAAACAAATTGTTTATGCCAAGATTCGAAATCAACGAACTTTACTTAGAAGAA
ATGGGGGAGTGAGGTAAAGGAGATTTTAACAGATTTAAAATCTTTAAGTGACAGT
GCACTGAACGCAATATCAATAGAACAATTACGGGGTATTGAAGGGATTTCTGCAAA
ACATTATTTCGCAGGATTTCCGTTTATGTTGAAAAATGAATTACGTGAATTGAATTTA
ATGAAAGGGCGTAATAGGAGACCGCCAAAAGATCCTGTAAATGTACTTCTTTCTCTT
GGTTATACTTTATTGACACGTGATATTCATGCTGCGTGTGGTTCAGTCGGATTGGATC
CGATGTTTGGTTGTTACCATCGTCCAGAAGCAGGTCGACCGGCTCTAGTATTAGATG
TTATGGAAACATTTCGACCACTTATTGTAGACAGTATTGTCATCCGAGCTTTGAATA
```

-continued
```
CGGGTGAAATCTCATTAAAAGATTTTTATATAGGAAAAGATAGTTGTCAATTATTAA
AACATGGCCGCGATTCCTTTTTTGCCATTTATGAAAGAAGAATGCATGAAACTATTA
CCGATCCAATTTTCGGCTATAAGATTAGCTATCGCCGTATGCTCGATTTGCACATTCG
AATGCTTGCAAGGTTTATTGAAGGGGAACTGCCGGAATATAAACCATTAATGACCC
GGTGAGTTTGTTTATTAGGTTAAAAGAAGGTGAAGACATGCAGCAATACGTCCTTGT
TTCTTATGATATTrCGGACCAAAAAAGATGGAGAAAAGTATTTAAACTGATGAAAG
GATACGGAGAACATGTTCAATATTCCGTATTCATATGCCAGTTAACTGAATTACAGA
AGGCAAAATTACAAGCCTCTTTAGAAGACATTATCCATCATAAGAATGACCAAGTA
ATGTTTGTTCACATCGGGCCAGTGAAAGATGGTCAACTATCTAAAAAAATCTCAACA
ATTGGGAAAGAATTTGTTCCATTGGATTTAAAGCGGCTTATATTTTGAAAAGATATA
GCAAAGAAATCTTATGAAAAAAATACAAAAATATATTGTTAAAAAATAGGGAATAT
TATATAATGGACTTACGAGGTTCTGTCTTTTGGTCAGGACAACCGTCTAGCTATAAG
TGCTGCAGGGGTGTGAGAAACTCCTATTGCTGGACGATGTCTCTTTTATTTCTTTTTT
CTTGGATCTGAGTACGAGCACCCACATTGGACATTTCGCATGGTGGGTGCTCGTACT
ATAGGTAAAACAAACCTTTTTAAGAAGAATACAAAAATAACCACTAACCTTGGGTGGT
AGGAATTTTGATGGATTTACATAACCTCTCGCAACATGCTTCTAAAACCCAAGCCCA
CCATAGCCCAAAACCCCCTGCGGTCCAAGAAAAAAGAAATGATACGAGGCATTAGC
ACCGGGGAGAAGTCATTTAATAAGGCCACTGTTAAAAGTCCAAGAAAAAAGAAATG
ATACGAGGCATTAGCACAACAATATAAACGACTACTTTACCGTGTTCAAGAAAAAA
GAAATGATATGAGGCATTAGCACGATGGGATGGGAGAGAGGACAGTTCTACTCT
TGCTGTATCCAGCTTCTTTTACTTTATCCGGTATCATTTCTTCACTTCTTTCTGCACAT
AAAAAAGCACCTAACTATTTGGATAAGTTAAGTGCTTTTATTTCCGTTTGAAGTTGTC
TATTGCTTTTTTCTTCATATCTTCAAATTTTTTCTGTTTCCTTGTTAAATAGTCAAC
CTGTAATCCCTTTTCTTTTGGCATTGGGGTATCTTTCCACCTTAGTGTGTTCATAAG
GCTTATATTTATCACTCATTGTATTCCTCCAACACAATTATAATTrTTCCGTCATCCTC
AATCCAACCGTCAACTGTGACAAAAGACGAATCTCTCTTAT (SEQ ID NO: 62)

>C-Locus
GTTTCATTTGGAAAGGGAGAGCATTGGCTTTTCTCTTTGTAAATAAAGTGCCCGT
AAGCTTTGTAATAAGCTTCTAGTGGAGAAGTGATTGTTTGAATCACCCAATGCACAC
GCACTAAAGTTAGACGAACCTATAATTCGTATTAGTAAGTATAGTACATGAAGAAA
AATGCAACAAGCATTTACTCTCTTTTAAATAAAGAATTGATAGCTGTTAATATTGAT
AGTATATTATACCTTATAGATGTTCGATTTTTTTCAAAFFTCCGTTATTGACGGAAC
AAAGAAAGGAAATAACGTCATGGACAAGCGAAAGCGTAGAAGTTACGAGTTTAGGT
GGGAAGCGGGAGGCACCAGTCATGGCAATCCGTAGCATAAAACTAAAACTAAAAAC
CCACACAGGCCCGGAAGCGCAAAACCTCCGAAAAGGAATATGGCGGACGCATCGGT
TGTTAAATGAAGGCGTCGCCTATTACATGAAAATGCTCCTGCTCTTTCGTCAGGAAA
GCACTGGTGAACGGCCAAAAGAAGAACTACAGGAAGAACTGATTTGTCACATACGC
GAACAGCAACAACGAAATCAGGCAGATAAAAATACGCAAGCGCTTCCGCTAGATAA
GGCACTGGAAGCTTTGCGCCAACTATATGAACTGCTTGTCCCCTCCTCGGTCGGACA
AAGTGGCGACGCCCAGATCATCAGCCGAAAGTTTCTCAGCCCGCTCGTCGATCCGA
ACAGCGAAGGCGGCAAAGGTACTTCGAAGGCAGGGCAAAACCCACTTGGCAGAA
GAAAAAAGAAGCGAACGACCCAACCTGGGAACAGGATTACGAAAAATGGAAAAAA
AGACGCGAGGAAGACCCAACCGCTTCTGTGATTACTACTTTGGAGGAATACGGCATT
AGACCGATCTTTCCCCTGTACACGAACACCGTAACAGATATCGCGTGGTTGCCACTT
CAATCCAATCAGTTTGTGCGAACCTGGGACAGAGACATGCTTCAACAAGCGATTGA
AAGACTGCTCAGTTGGGAGAGCTGGAACAAACGTGTCCAGGAAGAGTATGCCAAGC
TGAAAGAAAAAATGGCTCAACTGAACGAGCAACTCGAAGGCGGTCAGGAATGGATC
AGCTTGCTAGAGCAGTACGAAGAAACCGAGAGCGAGAGCTTAGGGAAAACATGA
CCGCTGCCAATGACAAGTATCGGATTACCAAGCGGCAAATGAAAGGCTGGAACGAG
CTGTACGAGCTATGGTCAACCTTTCCCGCCAGTGCCAGTCACGAGCAATACAAAGA
GGCGCTCAAGCGTGTGCAGCAGCGACTGAGAGGGCGGTTTGGGGATGCTCATTTCTT
CCAGTATCTGATGGAAGAGAAGAACCGCCTGATCTGGAAGGGGAATCCGCAGCGTA
TCCATTATTTTGTCGCGCGCAACGAACTGACGAAACGGCTGGAGGAAGCCAAGCAA
AGCGCCACGATGACGTTGCCCAATGCCAGGAAGCATCCATTGTGGGTGCGCTTCGAT
GCACGGGGAGGAAATTTGCAAGACTACTACTTGACGGCTGAAGCGGACAAACCGAG
AAGCAGACGTTTTGTAACGTTTAGTCAGTTGATATGGCCAAGCGAATCGGGATGGAT
GGAAAAGAAAGACGTCGAGGTCGAGCTAGCTTTGTCCAGGCAGTTTTACCAGCAGG
TGAAGTTGCTGAAAAATGACAAAGGCAAGCAGAAAATCGAGTTCAAGGATAAAGGT
TCGGGCTCGACGTTTAACGGACACTTGGGGGGAGCAAAGCTACAACTGGAGCGGGG
CGATTTGGAGAAGGAAGAAAAAAACTTCGAGGACGGGGAAATCGGCAGCGTTTACC
TTAACGTTGTCATTGATTTCGAACCTTTGCAAGAAGTGAAAAATGGCCGCGTGCAGG
CGCCGTATGGACAAGTACTGCAACTCATTCGTCGCCCCAACGAGTTTCCCAAGGTCA
CTACCTATAAGTCGGAGCAACTTGTTGAATGGATAAAAGCTTCGCCACAACACTCGG
CTGGGGTGGAGTCGCTGGCATCCGGTTTTCGTGTAATGAGCATAGACCTTGGGCTGC
GCGCGGCTGCAGCGACTTCTATTTTTTCTGTAGAAGAGAGTAGCGATAAAAATGCGG
CTGATTTTTCCTACTGGATTGAAGGAACGCCGCTGGTCGCTGTCCATCAGCGGAGCT
ATATGCTCAGGTTGCCTGGTGAACAGGTAGAAAAACAGGTGATGGAAAAACGGGAC
GAGCGGTTCCAGCTACACCAACGTGTGAAGTTTCAAATCAGAGTGCTCGCCCAAATC
ATGCGTATGGCAAATAAGCAGTATGGAGATCGCTGGGATGAACTCGACAGCCTGAA
ACAAGCGGTTGAGCAGAAAAAGTCGCCGCTCGATCAAACAGACCGGACATTTTGGG
AGGGGATTGTCTGCGACTTAACAAAGGTTTTGCCTCGAAACGAAGCGGACTGGGAA
CAAGCGGTAGTGCAAATACACCGAAAAGCAGAGGAATACGTCGGAAAAGCCGTTCA
GGCATGCGCAAGCGCTTTGCTGCTGACGAGCGAAAAGGCATCGCAGGTCTGAGCA
TGTGGAACATAGAAGAATTGGAGGGCTTGCGCAAGCTGTTGATTTCCTGGAGCCGC
AGGACGAGGAATCCGCAGGAGGTTAATCGCTTTGAGCGAGGCCATACCAGCCACCA
GCGTCTCTTOACCCATATCCAAAACGTCAAAGAGGATCGCCTGAAGCAGlTAAGTC
ACGCCATTGTCATGACTGCCTTGGGGTATGTTACGACGAGCGGAAACAAGAGTGGT
GCGCCGAATACCCGGCTTGCCAGGTCATTCTGTTTGAAAATCTGAGCCAGTACCGTT
CTAACCTGGATCGCTCGACCAAAGAAAACTCCACCTTGATGAAGTGGGCGCATCGC
AGCATTCCGAAATACGTCCACATGCAGGCGGAGCCATACGGGATTCAGATTGGCGA
```

-continued

```
TGTCCGGGCGGAATATTCCTCTCGTTTTTACGCCAAGACAGGAACGCCAGGCATTCG
TTGTAAAAAGGTGAGAGGCCAAGACCTGCAGGGCAGACGGTTTGAGAACTTGCAGA
AGAGGTTAGTCAACGAGCAATTTTTGACGGAAGAACAAGTGAAACAGCTAAGGCCC
GGCGACATTGTCCCGGATGATAGCGGAGAACTGTTCATGACCTTGACAGACGGAAG
CGGAAGCAAGGAGGTCGTGTTTCTCCAGGCCGATATTAACGCGGCGCACAATCTGC
AAAAACGTTTTTGGCAGCGATACAATGAACTGTTCAAGGTTAGCTGCCGCGTCATCG
TCCGAGACGAGGAAGAGTATCTCGTTCCCAAGACAAAATCGGTGCAGGCAAAGCTG
GGCAAAGGGCTTTTTGTGAAAAAATCGGATACAGCCTGGAAAGATGTATATGTGTG
GGACAGCCAGGCAAAGCTTAAAGGTAAAACAACCTTTACGAAGAGTCTGAGTCGC
CCGAACAACTGGAAGACTTTCAGGAGATCATCGAGGAAGCAGAAGAGGCGAAAGG
AACATACCGTACACTGTTCCGCGATCCTAGCGGAGTCTTTTTTCCCGAATCCGTATG
GTATCCCCAAAAAGATTTTTGGGGCGAGGTGAAAAGGAAGCTGTACGGAAAATTGC
GGGAACGGTTTTTGACAAAGGCTCGGTAAGGGTGTGCAAGGAGAGTGAATGCTTG
TCCTGGATACCTGTCCGCATGCTAAATGAAATTCAGTATTGTGAGCGACTGTACCAT
ATTATGCATGTGCAGGGGCTGTTTGAGGAAAGCGCAGACACGGTCGAAGGAGCAGC
ACAACACAAGCGTGCAGAGACACATCTGCGCAAAAGCAAGGCAGCGCCGGAAGAG
ATGTGGGGGACGCTCCGTTTAGCTTGCAGCTCGGCGACCCTGTGCTrGGCATTACG
GGAAAGCTGGATGCCGTCTGTCTGGAAGAAGGTAAGCAGTGGATTCCGGTAGAAGG
AAAGCATTCGGCGTCGCCAGAAGGCGGGCAGATGTTCACTGTAGGCGTGTATTCGCT
GGACGGTTCTGCCTGGCCCAACGACCAAATCCAATTGTGTGCGCAAGGCTTGCTGCT
TCGCGCGAATGGATATGAATCCGATTATGGCTACTTATACTACCGTGGCAATAAAAA
GAAGGTTCGCATTCCTTTTTCGCAGGAACTCATAGCGGCTACTCACGCCTGCATTCA
AAAAGCTCATCAGCTTCGGGAAGCCGAAATTCCCCCTCCGTTGCAGGAGTCGAAAA
AGTGCTTTCGATGCTCGTTAAATTACGTATGCATGCCTGACGAGACGAATTACATGT
TGGGGTTGAGCGCAAACATCAGAAAGATTGTGCCCAGTCGTCCAGATGGCGGGGTA
CTGTATGTTACAGAGCAGGGGGCAAAACTGGGCAGAAGCGGAGAAAGCTTGACCAT
CACCTGCCGGGGCGAAAAGATAGACGAAATCCCGATCAAAGACTTGATTCACGTGA
GCTTGATGGGGCATGTGCAATGCTCTACGCAGCTTCTGCACACCTTGATGAACTGTG
GCGTCCACGTCAGCTACTTGACTACGCATGGCACATTGACAGGAATAATGACTCCCC
CTTTATCGAAAAACATTCGAACAAGAGCCAAGCAGTTTATCAAATTTCAGCACGCGG
AGATCGCCCTTGGAATCGCGAGAAGGGTCGTGTATGCGAAAATTTCCAATCAGCGC
ACGATGCTGCGCCAATGGCTCACCAGATAAAGCAGTTTTAAAAGAGTTAAAAGA
GCTTAGAGATCGCGCGTGGGAGGCGCCATCACTGGAAATAGTGAGAGGTATCGAGG
GACGTGCAGCACAGTTGTACATGCAGTTTTTCCCTACCATGTTAAAGCACCCAGTAG
TAGACGGTATGGCGATCATGAACGGTCGCAACCGTCGCCCGCCCAAAGATCCGGTC
AATGCGCTGCTCTCCCTCGGCTATACGCTTCTTTCACGGGATGTTTACTCCGCATGTG
CCAATGTCGGACTCGATCCACTGTTCGGCTTTTTCCATACGATGGAGCCGGGCAGAC
CAGCTTTGGCACTCGATCTGATGGAACCGTTCCGCGCCTTGATTGCCGATAGCGTAG
CGATACGTACCTTGAATACGGAGGAACTCACCCTCGGGGACTTTTATTGGGGAAAA
GACAGTTGTTATTTGAAAAAGGCAGGAAGACAAACGTATTTCGCTGCCTATGAAAG
ACGGATGAACGAGACGCTGACGCATCCGCAATTTGGGTATAAGCTCAGCTATCGCC
GTATGCTGGAGCTGGAAGCAAGGTTTTTGGCCCGGTATCTGGATGGAGAGCTGGTG
GAATATACGCCGCTCATGACAAGGTAGGAAATGACCATGCGACAATTTGTTCTGGTA
AGCTATGATATTGCCGATCAAAAACGTTGGAGAAAAGTATTCAAGCTGATGAAGGG
GCAAGGCGAGCACGTCCAGTACTCGGTGTTTCTGTGCCAACTCACCGAGATTCAGCA
AGCCAAGCTAAAGGTAAGCCTGGCGGAGCTGGTTCACCATGGAGAAGACCAGGTCA
TGTTTGTAAAAATCGGCCCAGTGACGAGAGATCAACTGGACAAGCGGATATCTACT
GTTGGCAGGGAGTTTCTGCCTCGCGATTTGACCAAATTTATCTATTAAGGAATGAAG
AAAGCTAGTTGTAACAAAAGTGGAAAAAGAGTAAAATAAAGGTGTCAGTCGCACGC
TATAGGCCATAAGTCGACTTACATATCCGTGCGTGTGCATTATGGGCCCATCCACAG
GTCTATTCCCACGGATAATCACGACTTTCCACTAAGCTTTCGAATTTTATGATGCGAG
CATCCTCTCAGGTCAAAAAAGCCGGGGGATGCTCGAACTCnTGTGGGCGTAGGCTT
TCCAGAGTTTTTTAGGGGAAGAGGCAGCCGATGGATAAGAGGAATGGCGATTGAAT
TTTGGCTTGCTCGAAAAACGGGTCTGTAAGGCTTGCGGCTGTAGGGGTTGAGTGGGA
AGGAGTTCGAAAGCTTAGTGGAAAGCTTCGTGGTTAGCACCGGGGAGAAGTCATTT
AATAAGGCCACTGTTAAAAGTTCGAAAGCTTAGTGGAAAGCTTCGTGGTTAGCACG
CTAAAGTCCGTCTAAACTACTGAGATCTTAAATCGGCGCTCAAATAAAAAACCTCGC
TAATGCGAGGTTTCAGC (SEQ ID NO: 63)

>D-locus
GAAGTTATGTTGATAAAATGGTTTATGAAAACGTGAGTCTGTGGTAGTAT
TATAAACAATGATGGAATAAAGTGTTTTTTGCGCCGCACGGCATGAATTCAGGGGTT
AGCTTGGTTTTGTGTATAAATAAATGTTCTACATATTTATTTTGTTTTTG
AAATGCAACTGAAAGCCGCATCTAGAGCACCCTGTGAAGACAGGGTTTTGAGAAT
AGCCCGACATAGAGGGCAATAGACACGGGGAGAAGTCATTTAATAAGGCCACTGTT
AAAAGT1TTGAGAATAGCCCGACATAGAGGGCAATAGACTTTTGCTTCGTCACGGAT
GGACTTCACAATGGCAACAACGTTTTGAGAATAGCCCGACATAGTTATAGAGATGT
ATAAATATAACCGATAAACATTGACTAATTTGTTGAAGTCAGTGTTTATCGGTTTTTT
GTGTAAATATAGGAGTTGTTAGAATGATACTTTTTGCCTAATTTTGGAACTTTATG
GATATAAGATAGACTTGATAAAAAGGTAAAGAAAGGTTAAAGAGCATGGCAGGA
ATAGTGACCTGTGATGAAGATGATGGTAGAATTAAAAGTGTTCTTAAAGAAAAACA
ATATTGGATAAGGAAAATAATTCAATAGATAAAAAATTTAGGGGGAAAAATGAAAA
TATCAAAAGTCGATCATACCAGAATGGCGGTTGCTAAAGGTAATCAACACAGGAGA
GATGAGATTAGTGGGATTCTCTATAAGGATCCGACAAAGACAGGAAGTATAGATTT
TGATGAACGATTCAAAAAACTGAATTGTTCGGCGAAGATACTTTATCATGTATTCAA
TGGAATTGCTGAGGGAAGCAATAAATACAAAAATATTGTTGATAAAGTAAATAACA
ATTTAGATAGGGTCTTATTTACAGGTAAGAGCTATGATCGAAATCTATCATAGACA
TAGATACTGTTCTTAGAAATGTTGAGAAATTAATGCATTTGATCGAATTTCAACAG
AGGAAAGAGAACAAATAATTGACGATTTGTTAGAAATACAATTGAGGAAGGGTTA
AGGAAAGGAAAAGCTGGATTAAGAGAGGTATTACTAATTGGTGCTGGTGTAATAGT
TAGAACCGATAAGAAGCAGGAAATAGCTGATTTTCTGGAGATTTTAGATGAAGATTT
```

```
CAATAAGACGAATCAGGCTAAGAACATAAAATTGTCTATTGAGAATCAGGGGTTGG
TGGTCTCGCCTGTATCAAGGGGAGAGGAACGGATTTTTGATGTCAGTGGCGCACAA
AAGGGAAAAAGCAGCAAAAAAGCGCAGGAGAAAGAGGCACTATCTGCATTTCTGTT
AGATTATGCTGATCTTGATAAGAATGTCAGGTTTGAGTATTTACGTAAAATTAGAAG
ACTGATAAATCTATATTTCTATGTCAAAAATGATGATGTTATGTCTTTAACTGAAATT
CCGGCAGAAGTGAATCTGGAAAAAGATTTTGATATCTGGAGAGATCACGAACAAAG
AAAGGAAGAGAATGGAGATTTTGTTGGATGTCCGGACATACTTTTGGCAGATCGTG
ATGTGAAGAAAAGTAACAGTAAGCAGGTAAAAATTGCAGAGAGGCAATTAAGGGA
GTCAATACGTGAAAAAAATATAAAACGATATAGATTTAGCATAAAAAACGATTGAAA
AGGATGATGGAACATACTTTTTTGCAAATAAGCAGATAAGTGTATTTTGGATTCATC
GCATTGAAAATGCTGTAGAACGTATATTAGGATCTATTAATGATAAAAAACTGTATA
GATTACGTTTAGGATATCTAGGAGAAAAGTATGGAAGGACATACTCAATTTTCTCA
GCATAAAATACATTGCAGTAGGCAAGGCAGTATTCAATTTTGCAATGGATGATCTGC
AGGAGAAGGATAGAGATATAGAACCCGGCAAGATATCAGAAAATGCAGTAAATGG
ATTGACTTCGTTTGATTATGAGCAAATAAAGGCAGATGAGTGCTGCAGAGAGAAG
TTGCTGTTAATGTAGCATTCGCAGCAAATAATCTTGCTAGAGTAACTGTAGATATTC
CGCAAAATGGAGAAAAAGAGGATATCCTTCTTTGGAATAAAAGTGACATAAAAAAA
TACAAAAAGAATTCAAAGAAAGGTATTCTGAAATCTATACTTCAGTTTTTTGGTGGT
GCTTCAACTTGGAATATGAAAATGTTTGAGATTGCATATCATGATCAGCCAGGTGAT
TACGAAGAAAACTACCTATATGACATTATTCAGATCATTTACTCGCTCAGAAATAAG
AGCTTTCATTTCAAGACATATGATCATGGGGATAAGAATTGGAATAGAGAACTGAT
AGGAAAGATGATTGAGCATGATGCTGAAAGAGTCATTTCTGTTGAGAGGGAAAGT
TTCATTCCAATAACCTGCCGATGTTTTATAAAGACGCTGATCTAAAGAAAATATTGG
ATCTCTTGTATAGCGATTATGCAGGACGTGCATCTCAGGTTCCGGCATTTAACACTG
TCTTGGTCGAAAGAACTTTCCGGAATTTCTTAGGAAAGATATGGGCTACAAGGTTC
ATTTTTAACAATCCTGAAGTAGAGAATCAGTGGCACAGTGCGGTGTATTAACCTATATA
AAGAGATTTATTACAATCTATTTTTGAGAGATAAAGAGGTAAAGAAGCCGTTCAACAC
CTTCATTAAAAAATATAAGAAGTGAAGTTTCGGACAAAAAACAAAAGTTAGCTTCA
GATGATTTTGCATCCAGGTGTGAAGAAATAGAGGATAGAGTCTTCCGGAAATTTGT
CAGATAATAATGACAGAATACAATGCGCAGAACTTTGGTAATAGAAAAGTTAAATC
TCAGCGTGTTATTGAAAAAAATAAGGATATTTTCAGACATrATAAAATGCTTTTGAT
AAAGACTTTAGCAGGTGCTTTTTCTCTTTATTTGAAGCAGGAAAATTTATTCCGAAG
GGTAAGGCAACACCTATACCATACGAAACAACCGATGTTAAGAATTTTTTGCCTGAA
TGGAAATCCGGAATGTATGCATCGTTTGTAGAGGGAGATAAAGAATAATCTTGATCTT
CAAGAATGGTATATCGTCGGACGATTCCTTAATGGGAGGATGCTCAATCAATTGGCA
GGAAGCCTGCGGTCATACATACAGTATGCGGAAGATATAGAACGTCGTGCTGCAGA
AAATAGGAATAAGCTTTTCTCCAAGCCTGATGAAAAGATTGAAGCATGTAAAAAAG
CGGTCAGAGTGCnTGATTTGTGTATAAAAATTTCAACTAGAATATCTGCGGAATTTA
CTGACTATTTTGATAGTGAAGATGATTATGCAGATTATCTTGAAAAATATCTCAAGT
ATCAGGATGATGCCATTAAGGAARRGTCAGGATCTLCGTATGCTGCGTTGGATCATT
TTTGCAACAAGGATGATCTGAAATRRGATATCTATGTAAATGCCGGACAGAAGCCTA
TCTTACAGAGAAATATCGTGATGGCAAAGCTTTTTGGACCAGATAACATTTTGTCTG
AAGTTATGGAAAAGGTAACAGAAAGTGCCATACGAGAATACTATGACTATCTGAAG
AAAGTTTCAGGATATCGGGTAAGGGGAAAATGTAGTACAGAGAAAGAACAGGAAG
ATCTGCTAAAGTTCCAAAGATTGAAAAACGCAGTAGAATTCCGGGATGTTACTGAAT
ATGCTGAGGTTATTAATGAGCNTRAGGACAGTTGATAAGTTGGTCATATCTTAGGG
AGAGGGATCTATTATATTTCCAGCTGGGATTCCATTACATGTGTCTGAAAAACAAAT
CTTTCAAACCGGCAGAATATGTGGATATTCGTAGAAATAATGGTACGATTATACATA
ATGCGATACTTTACCAGATTGTTTCGATGTATATTAATGGACTGGATTTCTATAGTTG
TGATAAAGAAGGGAAAACGCTCAAACCAATTGAAACAGGAAAGGGCGTAGGAAGT
AAGATAGGACAATTTATAAAGTATTCCCAGTATTTATACAATGATCCGTCATATAAG
CTTGAGATCTATAATTTTAGGATTAGAAGTTTTTGAAAACATTGATGAACATGATAAT
ATTACAGATCTTAGAAAGTATGTGGATCATTTTAAGTATTATGCATATGGTAATAAA
ATGAGCCTGCTTGATCTGTATAGTGAATTCTTCGATCGTTTCTTTACATATGATATGA
AGTATCAGAAGAATGTAGTGAATGTGTTGGAGAATATCCTTTTAAGGCATTTTGTAA
TTTTCTATCCGAAGTTTGGATCAGGAAAAAAAGATGTTGGAATTAGGGATTGTAAAA
AAGAAAGAGCTCAGATTGAAATAAGTGAGCAGAGCCTCACATCGGAAGACTTCATG
TTTAAGCRTGACGACAAAGCAGGAGAAGAACI CAAAGAAGTTTCCGGCAAGGGATGA
ACGTTATCTCCAGACAATAGCCAAGTTGCTCTATTATCCTAACGAAATRGAGGATAT
GAACAGATTCATGAAGAAAGGGAGAAACGATAAATAAAAAAGTTCAGTTTAATAGAA
AAAAGAAGATAACCAGGAAACAAAAGAATAATTCATCAAACGAGGTATTGTCTTCA
ACTATGGGTTATTTATTTAAGAACATTAAATTGTAAAAAAGATTCGTTGTAGATAAT
TGATAGGTAAAAGCTGACCGGAGCCTTTGGCTCCGGACAGTTGTATATAAGAGGAT
ATTAATGACTGAAAATGATTTTTGTTGGATTTTTAGTCAGTTTTTTCTGTGGAAA
CGAATATGATGAGTATGCATATGGCAGTAAGAGCTGTAGAAGGCGAGAATACATATG
ATTACATTACTAAGGAAGAAAGACCGGAACTTAATGACGAATATGTAGCGAGACGT
TGCATTTTCGGTAAAAAAGCAGGAAAAATATCCAGGTCGGATTTTAGTAGGATAAG
ATCTGCGTTGGATCATGCGATGATAAATAATACACATACGACATTTGCCAGATTTAT
CACTGAAAATCTGACGAGACTCAATCACAAAGAACATTTTCTGAATGTGACACGTGC
ATATTCTAAACCTGATTCTGAAAAATTGATACAACCGAGATACTGGCAGTCGCCTGT
AGTTCCAAAGGATAAACAAATATATTATAGCAAGAATGCGATTAAAAAATGGTGTG
GTTACGAAGATGATATTCCGCCTCGTTCTGTGATAGTTCAGATGTGTCTATTGTGGG
GGACTGATCATGAAGAGGCAGATCATATCCTTCGCAGTTCAGGATACGCGGCGCTTA
GTCCTGTTGTACTTCGAGATCTTATCTATATGTATTATCTGGATCATCAGGATTTGCA
AAAAAATGAGTTGATATGGGAAGTAAAAAAGCAGTTGGATCACTTCGATTTGACAA
ATAGAAATTATGATACAAATCCTTTTGATGTAGGGGGCAGCGTAAATGATCATATCT
GTGAACTGAGCGAGCATATAGCGAAGGCTCATTATATTTATGAGAGGGCTAAGGAA
GGACCATTGCAAAATGTAATTCGGGATATTTTGGGAGATACACCTGCCCTTTATTCT
GAAATGGCATTTCCTCAGCTAGCATCTATAAACAGGTGTGCTTGCAATTCGCTTTCTT
CATATCAAAAAAATATTTTTGATACTGACATAGCTATATATGCAGATGAAAAGGACA
CAAGAGGTAAATCAGACCGTATCCTTGTTGAGGGCGCATCTTCGAAATGGTATGAAT
```

-continued
```
TGAAGAAACGCGATGCTAATAATGTCAAAATTTCTGAAAAGCTGAGTATACTCAAT
ACTATTCTTAAATTTAATAGTGTTTTTTGGGAAGAATGTTACCTTGATGGAAATATAA
AACAATCGAGCGGAAAGCGATCTGAGGCAGGAAAAATTCTTTATGGTCGCGACAAC
GGAAAAGAAAATGTCGGAGTTTCAAAATTGGAATTGGTGCGGTATATGATAGCTGC
AGGTCAGGAACAAAATCTGGGAAATTACCTGGTGAGTTCAGGATTTTGGAGAAAAA
ATCATATGCTGTCATTATACAAGGCAATGATATAGCGCTTGATGAGATGGATGAAT
TGGATCTCTTAGACTATATTCTGATATATGCATGGGGATTTAGGGAAAATATCATTA
AAAAGAACAGTAATGTGAATTCTTTGGATGAAAAGACTAGAAAAGTGCAGTTTCCG
TTTATAAAGTTACTCATGGCAATTGCAAGAGATATCCAGATACTTATATGTTCAGCA
CATGAAAAAACAGTCGATGAGTCATCTCGAAATGCAGCAAAGAAGATAGATATATT
GGGAAATTATATTCCTTTTCAGATTCATCTTCAGAGAACTAAAAAAGATGGTGGAAG
AGTGGTAATGGATACATTGTGTGCTGATTGGATTGCGGATTATGAATGGTACATTGA
TCTTGAGAAAGGAACACTTGGATGAGCAGTGATGAAAGGATATTTAAAAAATTTTT
GGAAAAAGGATCGATTTCTGAGCAGAAAAAGATGCTTTTAGAAGAAAAGAAATGTT
CGGATAAACTAACTGCACTGCTTGGGAATTACTGCATACCGATAGACAATATTTCAG
AGTCAGACGGAAAAATATATGCGGTCTATAAGCTTCCAAAAAATGTTAAACCTTTGT
CCGAAATCATTAATGATGTATCCTTTTCTGATTGTACGATGAGAGTACGTTTGCTTCT
CATAAAGAGAATTCTGGAACTCGTGTGTGCTTTTCACGAAAAAAAAATGGTATTGTCT
CAGTATTTCACCGGGAATGCTCATGGTTGAAGATTTTGATATACCGATGGGAAATGT
CGGAAAAGTATTGATATATGATTTCAGAAATCCTGTTCCGTTCGAGTCAGTAAATGA
AAGACATAATTTTAACGTTTCAAATAAATACACTTCACCGGAGCTGCTCATCCATTC
AAGATATGACGAGTCGAAATCTGTGAGTGAAAAATCAGATTTGTATTCTGTTGCAAA
AATTGCGGAAACAATAATAGGAGATTTTAACAGTATTATTGCAAATGGAAATTTGAT
ACTACTTGCAATGCTTAGAGTTTTTATCAGTACAGGGAAAAGTCCGGAACCTGAGTA
TCGGTTTGAATCGTCGGAAAATATGCTTTCAGTATTTGAAAATTTGATCAAAGAAAA
TTGTTTTTTTGAAAAAAACGATTATACATCTATGTTTCATCAGGCGTATGACAATTTT
TTTGAATGGCAGGAATGTTTGATATCACCGGATCACTTGGATAAAAAATATGTTCGAG
GCAGCTTTATCAAATCTTGAGGATCAGCTGCTTAGGGTTGATATTGATAAGTATAGA
GCAGAGTACTTCTATAAGCTTCTCCGAGAGTTGTCTAATAAATATAAAAATACAATr
ACTGATGAACAAAAGGTAAGGTTGGCAATACTTGGAATCAGAGCGAAAAATAATCT
GGGAAAAAGTTTTGATGCATTGGAAATATATGAGTCAGTACGTGATTTAGAAACTAT
GTTGGAGGAGATGGCAGAGCTTAGTCCTGTCATTGCTTCGACATATATGGATTGCTA
CCGATATGCAGATGCGCAGAAAGTGGCGGAAGAAAACATTATCAGGCTTCATAATA
GTAATATTCGTATGGAGAAAAAAAGAATACTGCTTGGAAGGTCATATAGTTCAAAA
GGGTGCAGCATGGGGTTTCAGCATATTCTTGGTGCGGATGAGTCATTTGAACAGGCT
TTATATTTCTTTAACGAAAAGGACAATTTTTGGAAAGAAATATTTGAGAGCAGAAAT
TTAGAGGACAGCGATAGACTTATAAAGTCTTTACGAAGCAATACGCATATTACGCTG
TTTCATTACATGCAATATGCATGTGAAACAAGGAGAAAGGAATTATATGGAGCACTT
TCAGACAAATATTTTATAGGTAAAGAATGGACAGAAAGACTCAAAGCATATATAAG
CAACAAGGATATATGGAAAAACTATTATGAGATATATATTCTGCTAAAGGGTATTTA
TTGCTTCTATCCAGAAGTCATGTGTTCGTCTGCGTTTTATGATGAAATCCAAAAAATG
TACGATCTTGAATTTGAAAAGGAAAAAATGTTTTACCCATTGAGTCTGATAGAACTG
TATCTTGCTCTGATAGAGATAAAAGTTAATGGGAGTCTGACGGAGAATGCCGAGAA
GTTGTTTAAACAGGCATTGACACATGACAATGAAGTCAAAAAAGGAAATATGAATA
TTCAGACCGCCATTTGGTATCGAATATATGCACTGTATAACGATGTAAAAGATGAAA
CTGATAAGAATAAAAGGCTTTTAAAACGGCTTATGATTCTTTGCCGACGATTTGTT
GGGCGGATATGTATAGTGCTTTGGAGAAGGATGGGAAGTTAATTGATTTTTTGAGAT
TTGAGGTATGTTAAATGATAACACTTGCATTAGATGAAAATGGCAAATTTGAAGATG
CTTTTTCTAAAAAAAATGAAAAACCGATAATGATTGCGGGGATAATCTATGATGACA
AGGGGAAAGAGTATGATGCTGAGAATGAACGCTACAGGATATCCAGTTATCTGCGA
GCAGTATGTGACAGTTTGGGTGCGAAATACCCTCAGGATCTACATTCAAATAGTAAT
GGAAATAAGGCGACTGTTGGGAAAGTAAAATGTAAAATTGGTGAAACACTAAAGGA
ATTCTTGAGAGAAGGAACCTATGAAAAAAGGAATTGCCGACAAAGAACGGTTATT
TAAATAAGAGATCTGGAAAATATGTAATGTTTGCAGAACTCAGGAGTAGTCAGGGA
GTTAAAAAGCGTGTTAGTGGTTGGAATGACAATGATCTGACTCAGGATGAAAAGGT
CAGCAATCTGTACCTTCATATGGCAGAAAATGCCGTTGTCAGAATGCTCTTCCATAA
TCCTATATATGAAGATGTAACAGATGTAAATCTCTATTTTCCCACGCGAAAAGTTGT
TCTGAAAGATAGAGATAGAGAATACGATAAACAAGATTTCAAAATATATGGTGATA
AGGACAAGTGCGAAGCAGAAAGCGGGAGATTGGTGCATTATGATATCGTGTCATCG
GATTTTTACCGTACGATAATGGAGAACGAATGTACAAGAATTAATAAAAAGCAATT
AAATGTTCATTATATGAACACAAGCCCAATTTCGTACTGGGAGAAAAATGAAAAAT
ATAATACATTTTTATATTTGGCTGACATAGTTTGTTCTATGCTGGAGGTGAAGTCCA
GGTTTTCGAGTCCGGCAGAGTGGATGGATTCTTTTGCCGAATGGGGAAACAAATATTT
TGGTGATGATCAGATAATCTTATTTGGGTATGATGATATAGATGACAAATACATGGA
GGCTGTAGATGCAGTAGGACAGGGAGAGTATTTTCATGCGCTGGATATTATATATGA
TGCGGAATGTAGTGGAAGTGAATTTGAGAAGCACTACAAAGATTATTGGTTTCCAA
AGCTTATAAAAAAGATACGAATAACAGCAACTGTGGATAATTTATGCAGATCGATC
TCAGATCTGGAGAGTTTTACATATCGAAGTAATCTTGATCAGCAGAACTTTTGTGG
ATTTTTGAGGAAATCAAAGCTATCGTCGATAAGGGAGATTTTGGAAAGAAATATCAT
ACAGATCAGGTTATGTTTGATATGTGTAATGCCGGTATTGCTGTGTACAATCATATC
GGAGATTTTGGGACTGCAAAGGAATACTATGATGAGTGCATGAAACACACTGGGA
TGTGGATCTGGTAAAGATACTTCGTGCATCAAATAAAATGGTGGTCTTTCTTGACGA
TGCTTTTAGGTATGGTGACGCGACAGAACGTGCCAGGAAGAATGTTGAATACCAAA
AAGCTTTGCACGATATAAAGAGTGAGATTTGTCCGGAAAAGAAAGATGAAGACTTG
AACTATGCCATATCGCTCAGTCAATTTGGACAGGCGCTTGCGTGTGAAAAAAATTCT
GATGCAGAGAGTGTTTTCCTAGAGTCGTTGCGGCATATGAGGAAAGGGACTGCCAA
TTATCAGATTACTCTTTCATATTTACTCCATTTTTATCTGGATATCCCGGTAATCA
TCTTATCGAGAAAAACAAAGGACTATTTTGGAAGTGAAAAACCAAAGGAACAGCT
GAAAGAATTGCTGAAGTTATCGGGAAAGGATGATAGTATAGTTACTTTCAAATTTGC
AATGTATGTCTATTTACGTGCACTTTGGGTATTACAGGAACCGCTTACTGATTTTATC
AGAACAAGATTAGAGGACATACGTGAGACTCTTGTAAAGAAGAAAATGAGTGAACA
```

-continued

```
TATGGTTGGACATCCGTGGGAGTTGATTTATAAATATCTGGCATTTCTTTTTTATCGT
GATGGAAATTGTGAAGCTGCTGAAAAATATATTCATAAAAGTGAAGAGTGCTTGGA
AACACAAGGACTGACTATAGATGCGATTATTCATAATGGTAAGTATGAATATGCAG
AATTGTCAGGTGACGAGGAGATGATGGCAAGAGAGAAAGCGTACTTTGATGAAAAA
GGGATAGATAGAAAAAATGTTTGTACTTTTATGTATCATTGATGTTTAATAAGATTT
GACCGAGGAGTGACAGGTAATCGCCGGTATATCTGGTATTACCTGTCATTTTTTGAT
GAAATAAGCTACTTTTTGCCTAAAAAACGAAACTGTTGGTGTTTTATGATGATTGTG
TCAACAAAAGAGAGCAAAAGAAGAGGAGAAAAGTAATGTCAATGATTrCATGTCCG
AATTGTGGTGGAGAGATATCTGAAAGGTCAAAGAAATGTGTTCATTGTGGATATGTG
TTAGTCGAAGAAGCTAAAGTAGTGTGCACAGAATGTGGAACTGAGGTAGAGAGTGG
CGCTGCTGTATGTCCGAAGTGCGGCTGTCCTGTAAATGATAGTGAGACGCCTCAGAA
AGTTGAAGTGACTAGGGTAAATGTATCTTCCGTAATCAGCAAAAAAGTCGTrGTAAG
CATACTGATCGCAGTGATTACAATTGCAGGTTTTTTCTATGGAGTGAAGTATTCGCA
GGAAAAGAAAGCAATTGAAGAGTCAGTAAAGCAGAAGGAAGACTATCAAAGTACG
CTAGAGCTTGCTTCGCTAATGATGCTTCAAGGAGCTTCGGATGCAGAAACTTGTGGG
AATTTGGTTAGGAAAGTGTGGAGCAACTGCATTTATAAGGAGAGGGATGAAGAAAC
CGACAAGTATACGTGTGATAGCAGGGGTGCAGGATGGTTTTATGATGATTTTAATGA
TGCATTAATGGCTCTTTACAGTGACAGCAGTTTTGGCAAGAAGATAAATGAAATCAA
AAACGGTCAGGAAACCGTTGCGGCGATGATGAAAGATCTGAAAAATCCGCCGGATG
AGATGGCAGATGCCTATGAGGATATTCAAAATTTTTATGTGTCCTATCTAACGCTGA
CAGAAATGGTTGTGAATCCAACTGGAAGTTTGAGTTCTTTTTCATCTGATTTTTCCGA
TGCGGATACGGAGGTGTCCAATGCCTATAGCCGGATGAAGTTGTATTTAGATTAAAC
TATTGAGGAAAAAATGGAGGTGCTTTAATGCGGGGGAGAAACTGTGGAGGGTCATC
AGGCGACGGACTGCTGGTACTTCTCGTACTGCTTGTCCTTTTTTATAAAATCATGCCA
TTCATAGGTTTATGGATTTTAATTTTTGGTGATGCTGAACGTAAAGATCTGGGTATGG
GTATGATTATTGTCGGGATAGTTCTATATGTATTATTAGAGGTTTTTTAATGTGAGTT
TCTGTGGTAAACTATAAAAGTACAAGCTTTTGCGCCGCACCGCATAAATAGCGGATT
TATGACCATTATTTGGTGAAAAAAATGGTGTACACCTGTGTTTTTTGTTTTGCGCCG
CAAAATGCGCCACGGAACCGCATGCAGAGCACCCTGCAAGAGACAGGGTTATGAAA
ACAGCCCGACATAGAGGGCAATAGACACGGGGAGAAGTCATTTAATAAGGCCACTG
TTAAAAGTTATGAAAACAGCCCGACATAGAGGGCAATAGACATAAAGACCAAAAAC
AGGTCATCTGCATACTGTGTTATGAAAACAGCCCGATATAGAGGGTGTGAGAGATA
TAGTTCTCGTCACAGTGCAGAAAATGACCTATTATGTGCCGAAAAACAAAATGAAA
AAAGAATGGAAAGGCGTATTTAATGAAATGCTGATCTGTTGATTTGAATTAACAAA
AAAAGGTCGCCCCACGGATGACAAAAACATCCGGGGGCGACCCTTTT (SEQ ID NO:
64)

>E-locus
TACTGTGTGCATAAGTCTTCCTTAGATCCATAGGTACAGCAGTTTTATTTA
TTAGCCTTAGAAAATGGAAAATAGAGCTTATAAATGATATGATATTTATGAATAAAA
TGATTGCATTCTCGTGCAAACTTTAAATATATTGATTATATCCTTTACATTGGTTGTT
TTAATTACTATTATTAAGTAGGAATACGATATACCTCTAAATGAAAGAGGACTAAAA
CCCGCCAAAAGTATCAGAAAATGTTATTGCAGTAAGAGACTACCTCTATATGAAAG
AGGACTAAAACTTTTTAACAGTGGCCTTATTAAATGACTTCTGTAAGAGACTACCTCT
ATATGAAAGAGGACTAAAACGTCTAATGTGGATAAGTATAAAAACGCTTATCCATC
ATTTAGGTGTTTTATTTTTTTGTGATTATATGTACAATAGAAAGGTCCAGGTAC
TTGAGGTGAAAACTATGAGAATTACTAAAGTAGAGGTTGATAGAAAAAAAGTACTA
ATTTCTAGGGATAAAAACGGGGGCAAGTTAGTTTATGAAAATGAAATGCAAGATAA
TACAGAACAAATCATGCATCACAAAAAAAGTTCTTTTTACAAAAGTGTGGTAAACA
AAACTATTTGTCGTCCTGAACAAAAACAAATGAAAAAATTAGTTCATGGATTATTAC
AAGAAAATAGTCAAGAAAAAATAAAAGTTTCAGATGTCACTAAACTTAATATCTCA
AATTTCTTAAATCATCGTTTCAAAAAAAGTTTATATTATTTTCCTCCTAAGAATTTAA
ACAAAAGCGAAGAATACAGAATAGAAATAAATCTCTCCCAATTGTTAGAAGATAGC
TTAAAAAAACAGCAAGGGACATTTATATGTTGGGAATCTTTTAGCAAAGACATGGA
ATTATACATTAATTGGGCGGAAAATTATATTTCATCAAAAACGAAGCTAATAAAAA
AATCCATTCGAAACAATAGAATTCAATCTACTGAATCAAGAAGTGGACAACTAATG
GATAGATATATGAAAGACATTTTAAATAAAAACAAACCTTTCGATATCCAATCAGTT
AGCGAAAAGTACCAACTTGAAAAATTGACTAGTGCTTTAAAAGCTACTTTTAAAGA
AGCGAAGAAAAACGACAAAGAGATTAACTATAAGCTTAAGTCCACTCTCCAAAACC
ATGAAAGACAAATAATAGAAGAATTGAAGGAAAATTCCGAACTGAACCAATTTAAT
ATAGAAAATAAGAAAACATCTTGAAACTTATTTTCCTATTAAGAAAACAAACAGAAA
AGTTGGAGATATAAGGAATTTAGAAATAGGAGAAATCCAAAAAATAGTAAATCATC
GGTTGAAAAATAAAATAGTTCAACGCATTCTCCAAGAAGGGAAATTAGCTTCTTATG
AGATTGAATCAACAGTTAACTCTAATTCCTTACAAAAATTAAAATTGAAGAAGCAT
TTGCCTTAAAGTTTATCAATGCTTGTTTTGGAATCCTTTATTTATTCCGGAAGFCC
ATATCCTGTTTGCAAAAAGGATATATTAATGATAGGTGAATTTAAAAATAGTTTTAA
AGAAATAAAACACAAAAAATTCATTCGTCAATGGTCGCAATTCTTCTCTCAAGAAAT
AACTGTTGATGACATTGAATTAGCTTCATGGGGGCTGAGAGGGAGCCATTGCACCAAT
AAGAAATGAAATAATTCATTTAAAGAAGCATAGCTGGAAAAAATTTTTTAATAACC
CTACTTTCAAAGTGAAAAAAAGTAAAATAATAAATGGGAAAACGAAAGATGTTACA
TCTGAATTCCTTTATAAAGAAACTTTATTTAAGGATTATTTCTATAGTGAGTTAGATT
CTGTTCCAGAATTGATTATTAATAAAATGGAAAGTAGCAAAATTTTAGATTATTATT
CCAGTGACCAGCTTAACCAAGTTTTTACAATTCCGAATTTCGAATTATCTTTACTGAC
TTCGGCCGTTCCCTTTGCACCTAGCTTTAAACGAGTTTATTTGAAAGGCTTTGATTA
CAGAATCAAGATGAAGCACAACCGGATTATAATCTTAAATTAAATATCTATAACGA
AAAAGCCTTTAATTCGGAGGCATTTCAGGCGCAATATTCATTATITAAAATGGTTTA
TTATCAAGTCTTTTTACCGCAATTCACTACAAATAACGATTTATTTAAGTCAAGTGTG
GATTTTATTTTAACATTAAACAAAGAACGGAAAGGTTACGCCAAAGCATTTCAAGAT
ATTCGAAAGATGAATAAAGATGAAAAGCCCTCAGAATATATGAGTTACATTCAGAG
TCAATTAATGCTCTATCAAAAAAAGCAAGAAGAAAAAGAGAAAATTAATCATTTTG
AAAAATTTATAAATCAAGTGTTTATTAAAGGTTTCAATTCTTTTAAAGGTCCATTA
```

-continued
GATTAACCTATATTTGCCATCCAACCAAAAACACAGTGCCAGAAAATGATAATATA
GAAATACCTTTCCACACGGATATGGATGATTCCAATATTGCATTTTGGCTTATGTGTA
AATTATTAGATGCTAAACAACTTAGCGAATTACGTAATGAAATGATAAAATTCAGTT
GTTCCTTACAATCAACTGAAGAAATAAGCACATTTACCAAGGCGCGAGAAGTGATT
GGTTTAGCTCTTTTAAATGGCGAAAAAGGATGTAATGATTGGAAAGAACTTTTTG
GATAAAGAAGCTTGGAAAAAGAACATGTCCTTATATGTTTCCGAGGAATTGCTTCAA
TCATTGCCGTACACACAAGAAGATGGTCAAACACCTGTAATTAATCGAAGTATCGAT
TTAGTAAAAAAATACGGTACAGAAACAATACTAGAGAAATTATTTTCCTCCTCAGAT
GATTATAAAGTTTCAGCTAAAGATATCGCAAAATTACATGAATATGATGTAACGGA
GAAAATAGCACAGCAAGAGAGTCTACATAAGCAATGGATAGAAAAGCCCGGTTTAG
CCCGTGACTCAGCATGGACAAAAAAATACCAAAATGTGATTAATGATATTAGTAATT
ACCAATGGGCTAAGACAAAGGTCGAATTAACACAAGTAAGGCATCTTCATCAATTA
ACTATTGATTTGCTTTCAAGGTTAGCAGGATATATGTCTATCGCTGACCGTGATTTCC
AGTTTTCTAGTAATTATATTTTAGAAAGAGAGAACTCTGAGTATAGAGTTACAAGTT
GGATATTATTAAGTGAAAATAAAAATAAAAATAAATATAACGACTACGAATTGTAT
AATCTAAAAAATGCCTCTATAAAAGTATCATCAAAAAATGATCCCCAGTTAAAAGTT
GATCTTAAGCAATTACGATTAACCTTAGAGTACTTAGAACTTTTTGATAACCGAT
AAAGAAAAACGAAATAACATTTCACATTTTAATTACCTTAACGGACAGTTAGGGAA
CTCTATTTTAGAATTATTTGACGATGCTCGAGATGTACTTTCCTATGATCGTAAACTA
AAGAATGCGGTGTCTAAATCTTTGAAAGAAATTTTAAGCTCTCATGGAATGGAAGTG
ACATTTAAACCACTATATCAAACCAATCGGTAACATTGGCCTGGCAACAATGGCTAA
AAAAAAATACACCACTTAGGTGAAAAAGTACTGTTTCTTCAAATCAAGTTTCTAAT
GAATACTGTCAACTAGTAAGAACGCTATTAACGATGAAGTAATTCTTTTAAAGCACA
TTAATTACCTCTAAATGAAAAGAGGACTAAAACTGAAAGAGGACTAAAACACCAGA
TGTGGATAACTATATTAGTGGCTATTAAAAATTCGTCGATATTAGAGAGGAAACTTT
AGATGAAGATGAAATGGAAATTAAAAGAAAATGACGTTCGCAAAGGGGTGGTGGTC
ATTGAGTAAAATTGACATCGGAGAAGTAACCCACTTTTTACAAGGTCTAAAGAAAA
GTAACGAAAACGCCCGAAAATGATAGAAGACATTCAATCGGCTGTCAAAGCCTAC
GCTGATGATACAACTTTAAAAGGAAAAGCAGTGGATTCTTCACAAAGATACTTTGAT
GAAACGTATACTGTTATTTGTAAAAGTATCATAGAAGCATTAGATGAAAGCGAAGA
GAGATTACAACAATATATTCATGATTTTGGAGATCAAGTGGATTCTTCACCTAACGC
ACGAATTGATGCGGAATTACTACAAGAAGCAATGAGTAGGTTAGCTGACATAAAGC
GGAAGCAAGAAGCACTTATGCAATCCTTATCTTCTTCTACAGCAACGCTTTACGAAG
GCAAGCAACAAGCGTTACACACTCAATTCACGGATGCGCTGGAGCAAGAAAAAATA
TTGGAACGCTATATTACTTTTGAACAAACTCACGGGAATTTTTTTGACTCATTTG
AACTTGTCTATCGAACGGGACAAGCAGTGCGTGAATTAGCTAATAACGTCACATTCG
AGAGCCAAACAGGAAGCTATCATTTTGATAAAATAGATGCTTCTAGATTCCAAACTT
TGCAAGAAATGTTGCCAAAGGCAAAGAAAAAAGCATTTAATTTTAATGACTACCAA
ATAACATGGAATGGCACCACGCACCTTTTATGGAAAAATGGTAAAGTGGATGCAGA
AGCAACCAAAGCTTATAACGAGGCGAAACTGAATGGAAAGCTACCAAAGGAAGGT
AATGTAGCAACACAAGATGCAGAACTATTAAAAGGCATTTTGGCTTCACTGAAAAA
CAAGAAAGATCCTATCACTGGAGCAGATATAAGCAGTGTGCATGTATTATCTATCCT
TAGCGGGCTCGCATTCTCCTATACAGCTGGGAATTATAAGGGAAGAAAACTTACTGT
TCCAAAAAGTTTCTTAGACAAATTAAAGAAAAACCGAAAATCTAAAGTACCTAAAC
TATCTAGTTTATCAGAAAAACAACAACTAAAACTCGCAAATAAATACAAGAAAAAA
TCACCTATTCCAATTCCAGATGATGCTAAAATCAAAGCTCAGACGAAAAAGGCTGGT
TATGAACAAATATCTTATAAATGGAAAGAGAATGGGATAACCTTTGAAGTTAGATG
GCATACTAGGACACCAGGTGCACCAAAGGAACAAGGAAATACGTTTGTTATAGAAA
GAAAAATTCAGGGTACAGCAGAAGGGAAACAAAAGTTCAACAAATATTGGTTGGA
GATAATAAGTGGGTGAGTAAAAGTGAGTGGCAAAAGGCTATAACTGATAAGAAAA
ATGGTGTAAGTACCTCGGAGCAAAATAAAATGTTGTCTGATGGACATTGGAAAGAA
TAGAAAGGAGCAAAATGATGGAAGATTATTATAAAGGTTTTGAGGGATATCCAGAG
ATAGATTTTTATACGTATATAGATGATATGAAATTGGGTATAGCAATGTGGGAAGGA
TACTTTGACAACATTATGAAAGAAATTAATCCAAGTAACGGAAGATGGACTTCATTA
GCGTATTATTATCATTTAGATGAGGGGTGGTATGATGAAAGTCCTTGGGAAATACCA
AGTAATACAGAAGCATTAGAATTATTGGAAACAATCCATATATCTAATCTAGATACT
ATCACACAAGAGATATTACTTAAATTAATAAATTTATTAAAGAAGAATATAAATAG
ACAAGTTTATATTGAATACTCATAAAAAAGATGATTATGATATATTATAGAACAAAC
GAACAAGCCCCAAATACGAGGTTTGTTCGTTTGTTTTCAATATAATTATTTGCCACCA
AGTGAGATATTACGGTTTTAAATAGOTATrTGACGATACCAAACCCTGATAAGAGA
AAGAAGAAAGAGAAAGCTGGTGTAGTTGTTTTAAGTGAACTAGATAAAAAATTAAT
AGCAAAACTTGAAAAGATGGTGTGAAAATATCAAAAGAAGATGTTATAGGAATAA
AATAATTGCCAGATGATGAGAAATCGTTTGGCTGGAAAAAGGAAATTCCATCCGCTG
GATTTGAGCATATTCTTATTGAACATGGTGAACAATTTGCTAAATAGGGAATTTCAA
AAGCTGAGTTACCTGATTTTTTGATGACTGCTTTAGAAAAGGAAA (SEQ ID NO: 65)

>F-locus
ATTCTTTAAAAATATCTAATAATTTATTTACTATATACTCTAATACATCTTT
TAACCTATCTAAAACATCATCACCTACAACATCCCAAAAATCATCTAAAAAGTTAAA
AAAATCCATCTTTATCAACTCCTATATCTATTTTTATTGTGTAATTCCTGAGTTACA
AAACCATTATAAACACGTATTACACACGTAGTCAATACTTCAAAAAAATTTTTTGTAT
ATTTTTTTGAATAAGTAAATAAAAAGAGCTGTCGGCCTCAACCTAATTGACCAC
TTATTTTGTTAACAAACTTAGACAACATTAAATTTAGAAACCTATATATATTTCAG
CTTTTCATTTTTAGGTAGTCTAAATCAGAAATGGTTTTGTCTAAATGATGTATGTA
TTTTAGTCCCCTTCGTTTTAGGGTAGTCTAAATCAGAAGTCATTTAATAAGGCCACT
GTTAAAAGTTTTAGTCCCCTTCGTTTTTAGGGTAGTCTAAATCCCATCCAAATTATGG
GATAATATGTTACTTTTTATTTTAATATTGGTTAATTCAACAGGTGGGGTAACACA
ATTACCCCTTTAATTTATTTTACCATATTTTTTCTCATAATGCAAACTAATATTCC
ATTTTTGTTTCTTTTCTTATGATCTTCCTTACCGAGAGACCAAGGGTTCAAGTTGC
CATTTTTTTGAATTGATCTTCTGTTAGAATTAATGTTCTTACTGATGAATTTCAGAG
ACTATCATTGACAACTGATTTTCATGGAAGAGACCTAAATTTGAACAAGGTTGAGGAC

```
-continued
CAATGTATACTGATTTTTGTACCTCCGGAAAGTTGAACGGTGAAGTTACCAACAACA
TTTGCATATTCTTTTTTTTCTTTTCCTGTTTGCATTGGAAAATCATACCCAGGTGAC
TACATAATTAGTACTCATAATCCTCTATCCTTAACTCAGGAATTTCTACTTCTGACAT
TTCTCCTGTAAAATAATTTCTAATATTATCTAAAAAATAATCAATCACTTGAGCCAAT
TCATATTTTTATTTTTCCAATAAACTTGGTTACCAAGTTGAAAGGTTAATTGCCAAG
TAATGATTTATTCAAACTTACTTCTTCCTGTTGATTAAAATATACGATATAATCTAC
ATTGGACGAAATATTTCAATAATATCATCTGCAAAATTATAATTATTAAATTGTGAA
CTGTGATGTATTCCCAAACTTGGATGAAATCCTTTAGCCACAATTTTTGAAGAGATT
AAGCTTCTCAAAACCATATACCCATAATTTAATGCCGAATTTGTCCCGTCTTCACCA
AATCTCTTAAATTTTTTCCCAAAAAGTTCACCAAAATACATTCTTGGGTTCAGAGA
CCTGATGTTCCGCTTCTTTTCCTTTTAATCTAATATTATTGGTTAATATTATGGAAGGA
TATGACACTTCCTGAGATTTTTTCAAAAACTGCAATAAATTTGGACCTAAAGGGTTG
TCTCATTACAATTTTTCTCCAGATTTCTTCTTTTTTATCGTCAATCCAGCTCCCGAGG
CATTAATTCnTGTTGTTACTTGAAAATGATTATACAGTCCTAATGAATGTAAAACTG
GCTGATGTTITrCATTACAAATTATCAGTGGAATATTATGTTCTGATAATCTTAACTG
TAATATTCCGCTAATTTTACATCTGCAATTTTCAACTACAATTGCCATGATATCATTT
AAAGATACTTTATCAGCCTTATTTTCATCATCTTCATTTATCATCACAAGCTGGTTAT
TTAAAACTGATAATTCATTGACTCTTGTTACATGGATAATATTAGACATTTTTATTAC
TCCTTTACTCTAAAGCTTTATATTCAAACATAACTTTCACAAGTTCACACAATTCT
TGAATTTCTATCAGTCATTAATTTTTTCTTGGTTGAAATATTTAAAGCCCTTTAA
CCGATTCTAAAGTCTGAATTTCTATTTTCTTATCTGCTCCTATTTTAAATGTTGCTACA
AAACCATATTCCTTTAATATATCCACTATTGATTTCATAATTGCATTTTTATTAATTCCA
ATCATAAGAAAGTAATTTTCTTAAATTTTCCAGCACTTCTAAAAGTGAAATTTCAGC
ATGCGGAATATAGTTAAATGTGCAATATAGTTTCGTATATACAAATCTTTTTTCTCT
TGTTTTAATTTTTTTACTTTTTTATCAGAATAAAGCCGTGGGTCAAGGGGAACGAGGA
TATAATTCTTTATAAAAATTTATATATTTTTCAAAATTTTTTCTTGGTATCTGCTCC
ATTTTTACTGTTATCAAAATTAAATATTTCTTCAATATAATGATTTTCAGGAAATTCA
CCTTTCAATCTAAATCTTAAGTCCCTTTCCCAGATCGAAGTATATCCCACAAGTCTGT
GGAGTATTTTAATAACAAGCCTTGCAACAAGTTTAATTCATTAAATTCCACTTTATT
TTTCAAATGAGTATATTTTGTATATTTCCAATTGCTTTTCATATTCTTTATTATT
CATCATTAAATTTTTCATCTTITITAGGTCTTGCATATTATTTTTTTATTTTTATTG
ATTGTATAATTTTTTCTATTTCATTTTTTTATTGCTGTATTCCAGCTATTTTTTC
CTTATTTTATACTTCGCTTTATCAGCTATTTTTTCAAGTAAATTTAACATCCCA
TTTTATATTATAAAAAGCTCTATGCTTTATAATATTTCTCCATCAAATATTTT
TTGTGTCAAATTTCTTCAATTCTTTCCTATCTTTTTCTAATTCAAAATCTCTCCATCA
AATTTTCCAATTTCATTCGCTTCTAATTCAAAATCTTCTGTTACTCTATTATTATCTAA
ATTTAAAAGATTTATAAGTTCAAGTTCATCTGAAAAAGTTTCAAATTAGTCAATT
TGATATTTTCAAGACTTCCCTTCAAATTAGTCAATTCTTTATGATTAAGCAATTTTA
AAATTAAATAAAACATATTCAAATTTTCAGTGTATTTTAATATCTTTCCTAATTTTAT
CTCTCTTACAAATTCATTTATTTCATGTGGAATTTCTTTATTCCTATTGGAATTTCTTTA
AATTTTTTAAAATTTTATCATATTTTTCTTTATTGTTATTATTACTTTCCCTATTGGAAT
ATATATCATTATTATCATTGTTATTATTACTTTCTATATATTTTAAATTATTTGTATAA
AAATAATCTATAAAACCTTTTAAAAATATTTGTTGTATAAAATCAATGTATGTAT
TTTCTTCTTTATCTTGATTATTAATCATCTCCCTACTTTGTATAATAGCAAGATATTCT
ACTGGTACAGTTTTTCTATATTTTCAAATTTACTTCATTAGTTATTTAAAGA
ATTTCTTGTTTATTTATTTTATTACTTCATTAGTTATTTTAAAGATAAATAT
TTITAACAAATTTATTAAGAAATTCACCATAATAAATATTTTTCAAAAGATATATTTG
AGCATCTTTTCTTCTTTATCCTTAGGAACACTCCAAAAAAATTTTTTAACAAAAGG
AAATCTTCTATTTTATTATATAATTTCGTAAAAGAAGGAACAAAAGGAATATCTTA
TTACAAAATTAAATTTTGTATTTTTAAATATTTAATTATCACATCCTTTTCATAATA
ATTAAATACATTTGCACTATTTAACTGCTTAAATATCTTCAATTTCAAGGAGGTA
TTATTTCATTTTGAAACATTTTTTTTGAAATTTAGGCTTCGTGGGTAAGAGGCCTA
AAATATATCTTTCCCTTCTAATTCCAAATTAAAATGCACAATCCCATGTCTAATACTG
CTAATAGCTTCATCAATATTTGCAAAAAAATCTTCTATCTCATTTTTATTATCCATAT
TAAAATCATAACTATAGAACATTTTTAAATTTTCTTTAGGTCCAGAGACCACTGGCAA
TTATATATTTTATCAACTTCTCCCCGGAATATATGGACCGCGGTAATTTGGCAGACTT
AGTTTTTCCTCTCATTCTACCTGTAATATCATTCTCATTTTCAGTTTCAAGAATATTTC
TCAATGAAAAATATGCAACCGAAGAAACTCCAATTATATTTCGTAAAAATGCTTCAT
TTTGTCTATTCCTAGCAATAAAATCACTTGTTGCAATCTCTCCAACTTGTAAATAATA
ATTGTATTTCCCACAATTTCTTACATAAGTATCCAATTTATTTAGTAATTTGTTTAGGT
TTAATTTTTTAAATTTTGATATTCAAATATTCTCTTAATTTAGGAAGTTCTCCG
CTCAGTCTTTTATACACATAATTTTTCAAAAGCTGACTCATTTCAATTTCCACAAAAT
GACAAAAAGCATATTTTATATTTTTATCATTAAGTTCTTCTTTATCCAAATAAGGACTT
ATAAAACACTTGTGATTTTTTTTAATTCACTCATATCCGGAATTTTTTCAATTAATTCTT
TTATATTATTTACATTTTGTATTTCTTCGTAAAATAGAGGTTAAGTTCTTCCGTAAAATAG
TTTTTTCTTCCAATTATTTTGTGATAGTATTCTCTTATTTGTATTTTTCTCAATAT
GAATTTTCTATTAAAAAAATAACTTCTCAATATCTTCTTTTAAAAATAACTTC
ATGCTTCCTGTACATTATTTATATAATCATTACGGAATTTTCTATTATCAATATC
ATAAATAATATTTCTTTTGCTCTTCCCTCCAACTTTTTCAACATTATTTTAATAT
TCTGATTAATTAGCCTTATTTTTTTCAAATGAATATTTAAAGAATTTATCTTATTCAA
TTTTGCCTCAACATCTTTTCTAAATATTTCTAATTCTTCAGAGTTCATTTTCTAAATAT
ACAATATTTTCTTTAAAACTGAAAAACTATTTTTATTTTTTCAACATCTTTTCTAAA
ATCTTCTTCAGAATAATTTTTATCCTGTACTGCATTTTTCTCTTTCCTATTTTCTCTT
ACAGAACACTATCTTTTAGATGCAATACTTATTTGAAAAAAACTTTTTAAAAAAA
TCTTCTTATTCTATTTTCTTCTTCACTTGCATTATCAGGATTTTTTATATATATA
GTCTTATACTTAAAAGCTCTGACAATCTCTCACTAGTCCTATTTTCTTCGCTCGTACT
TTTTACTAATTTTCCCTCTTCAATATATTTTTTATGCGAAATATATTTTTTATGC
CTTTCATATATAAAACCTCCTAATATCTATATTTTTTCCTAATATCTACTAATATC
TCAATGCTTTTTGTAAAATTTGTGAAAAATTCAGATTTTTTCCTGTGCCAATTT
TAACCAAACAGGAATTGTTAAAGTTTTCTTTTTAAGTGCATTTGTAACTTTTCTTT
TCATACACTGGATCAACAGATAAAATATACAAATACTGATCAGTTTCACAAATACT
```

-continued
```
TCCTCCACTTTTGAAGGCTCAGGAAATTTTTTCTTACATCCAAAAAATCAGCCAAAT
GCAGACCCAATGTCTCTCTCAAATTGGAAACAGCCTCCTCCATGCTATCTCCAAATG
TAGCATAATAATTTATCTCTCCATCTTCAAACTTATCAAAATCAACAATACAACCAT
AATAAGTCCCATCTTCCTTAGTTACCACTGCTGGATAAAATACATCCATTTTAATTAT
CTCCAATCTATACCACGTGTTAAATACGTGTTTAAAAATATTTATAAAATTTTTTAGC
ATCTCTGCTAAAATAAAACAATTATTTCAAATTTTTCTATTCCTTAATCACTCATT
TAGTGATTCTTTTTTTACTTGGACAATTTTTCTTCAAATTTTTCTATTCCTTAACTTA
CACATTTTTTAATATTCCTTATTTAATTGCAAATTTTCATTACTTTTGGGGTGCTCTA
AATCCCATCCAAATTATGGGATAATAATTTTTAGTGAAAGCAAGAAGGGACTAGAA
TTTAATCCCAACTTGTTTTTCAATACTTCTTAATCAAGTTTTTCAATACTTCTTAAT
ATGGTACTGTGACCACACCTTCCACACCTGGGATCATCCATTGATAATGACTACCTC
TTATACGCACAACTTTTCCGCCTAATTTTCTAAATCTTTTTTCGAT (SEQ ID NO: 66)

>G-locus
CTTTCTATCTTTTTCAAATAAAATTAGGCTCTAGTTAGCCTAATCGCATAA
TTATTTATTATAGTATAATTCTTATTTTTTTTCAACCTAAAAATTTTATTCAAA
AAAATTTTCGTTTCAGAACAACCAAGCAACCATATTCAAAAAACAATAAAAAATGA
GCAAGAATTGAAATTTTATTCTCACTCAGAAGTTATTTTTATTAAATATCACTTTTCG
ATATTGGGGTGGTCTATATCAATTTAAAAGACAGAATAGATAATTCTTTAGAGTTTT
AGTCCCCTTCGATATTGGGGTGGTCTATATCAGAAGTCATTTAATAAGGCCACTGTT
AAAAGTTTTAGTCCCCTTCGATATTGGGGTGGTCTATATCCCATCCTAATTTCTTGCT
GATGAGATATTTATTTCTAATTTTTCTATTTTGTCAAACCCCTTCGATATTGGGG
ATTTTTTCTCTTTATTAATAATATAGAACCACCCTATATTGGGGTGGTCTAGGATAAT
TTTTCAAAATTCCAATATTTTGTTTTGTGAAATTTTTTCTCCCAATATTGGGGTTTG
CAAGTACCTTCATTTTTTGAAACTGATCTTCTGTCAGGATAATGGAACGGATTGATG
AATTTTCTGGAGCGAGCATTGATAACTGTTTTTCTGCCAGTTCGATTTTTCTTTTG
TTCGACCTCATTATATATACCGATTTTTGAAGCTGATAATATCCCTTTTCTATCAATT
TTTTCCTAAAAGTCCTATATTCAAATCTCTCAACATCTGTCTGCATAGGAAAATCATA
CATAAGCAGACCAAAATACTCAATACTCATAGTCCATCACGCTCAATGTCGGAATTA
TCACTTCTTCATCTTTTACAAAATAATTTCGTATACTATCCAAATAATAGTCTACCGC
TTGGAAAAAATCATATTTCITATTGTTAAATAATACCTTCTGCTGTGCTACAAGAAGT
ATTTTTTGCCTTATTTCCTTACTTAATTTCACCAAAATACTCAATACTCATAATTTC
AACAAGATAATCCACCATAGGACGAAAAACCTCTATTATATCATCAGAAAAATTAT
AGGCATTAAACTGTGACTTATGATGTAATCCTAAACTTGGATGAAATCCTTTTGCTA
CAATCTTTGATGATATTATAGCTCTTAAAATCATATATCCATAATTAAGTGCAGAATT
CACTCCATCTTCATCAAATCTTTTAAAACTATTACTATACAATTCCTGAAAATATATC
CTTGAAGCTATTGCTTCCTGATGTTCTGCACTCGCATCATCTTTTTTCAAGTTTTCC
ATATGTTTTCAGTCTTTCAATGGAAATATCACTTTTTTCAAGATACTCTAACAATGCT
CTTTGATTTTCAATCTTATTCTCCTATTGCTTCCTGATGTTCTCACTCGCAATACTC
TCCCACTCAATCTGCTCATTTATTCGTAAAGTCACTTGAAAATGATTAAATAATCCCA
GCGAATGAATTTCAGGCTGATGTTTCTCGTTGCAAATAATAATCGGAATGTTATTTTC
CACCAGCCTCAACTGCAAAATCGCACTAATCTTACAATAGCAGTTTTCAATAACTAT
CGCAGATATATCATTCAAAGAAATCTTATTTTTCTCATCATTATTGTCTTCATCAACC
ATTATAAGCTGATTATTCGATATTGACAAATCATCAGCCCTTGTTATGTGAATTATAT
TGGGCATTTTAATCATACTCCTTATAAATTTCATTCTTATAACGTATCATTCGTATTTT
CTATTTTGTTAAAAGTTCTATTATCAAGTTTTTAATAATCATACTCCTTATACATTCT
TAATTCTAAAACAGAAACTTTTTTAGGTTTCATTAATCTTAAAGTTCTATTATCAAGTT
CCGATAAGTTTAAATTTTTCTTTAATTCTAAAACAGAAACTTTTAATCTTAAAG
TACTTCAAATACACTTGCATAAGTTGAATTATTATACGTGTACTATATGATAATAA
ATTAGAAACTCTATCAATTTGTTCTGCAATACTGTAATCAGCAAACGGATTTCTTAC
AATATAGAAATGTGAAATATAGTTTCTAATACTTTCATTTTCCGGCTTATTAATTTCA
GAATTTTCAGACAAATCAATTCCAAATCCATAACATATTCTAATACTTTCATATTTTCC
ATTCTTCATCAAAAAATTTATAGTATGCTGTTGTTGTATAAAAGCCATCAGATCCATT
ACGCTTAGGATAAGCTCTACTTATTCCAGTATTGTAGCCACTTAACTTAATAATTCCT
AATTCTCTTAGCCCATTTACAATATAGTGCATATCTCTTTCAAATCTAGCCATTTGAA
TAGCAAGTTTCCAATTTATATCTATCAAATAACTTTCTATTTTATTCAAATAATTAAA
TTCTACCAAATCTCTAATTTTTTTGTATTCAGAAACGTTTCCAATTTATATCTATCAA
ATTTATAGTTTTTATTTTGTATATTTTTGCAAAAAGTCATCATTTTCTAATTTTT
TTTATATACTTCTCTTTGTATTCTTTAGAATATCCATTTAGTTTATCATTTAGATTT
CAATATTGCATCAATTTCAGATATTTTATTTTTTCTAATATTTTTTGTTTTTGTATT
ATAAAAATTTTGCATCAGCCATTTAATATCATTTGAATTAATCCAGAAACGCATC
AAAATTTGGATTTCCAATATTTAAAAATAAATTCTTTTAGCCATTTTAAATAAATT
TTACGTTCTTTAGGATAATATATTTCTTGAAATTTATTTTCATTCTATCTCTTTTAGC
TTCTATTAAATTATCTATTTCTTTTTTGTATTTTTTTATTCAGAAATTTGAAATTA
TTCTACACAATATTTTACTCTTTATTTCCTGATCTTTATATTCTGCCTAATAATGCCT
TTTTTTTTCAAATCCTTTTTATTTATGTTTGATAACTTTCTTTGTTCAATCTTTATATT
TTCGATTTTTATCTATCTCAAATTTAGTTTCATCATCAAAAATTACAATATATTAATA
TTTTTCTCTAAAACATCACAACCTTCTACACAATATTTTACTTAAAAATTTCTAGTT
TTTTTTATATCCTCATAATAATTATTAAAAATTTCTTTTTAGTTTGTATTAGTTT
ATCAAAGTCTTTTTCTATCTCTTTCATTTTTTGAATAAATTCTTCTAAATAGATA
AATTTTCAGTTATACATTCATTTCTCAAAGTATTTAATTGCATTATTTCATCTAAAAT
ATCTATAATATTTTGATATTCTGAAGTATTTAACCAAACTGATGTTGCAAAAAATCT
ATTTCTAATTTTATTTATAACCGCATTACTATTTAACAGTGCAAATATTGAAATTATA
TATTCAAATCATCATTTATTACTATAGTTTTATCCATTTATTACTATAGTTCTATA
GTAAGTTTTATTATCATTAATGTCTTTTATTTGTTTCTTAACTATAGTTTTATCCATTT
TAAAATCTGAAAAATCAAAAAGTTCCTCATAATTTTTTCTCAAATATCCAATATAAC
ATTCTATTACTTTTTCTGATATTTTTAATAGCTTTATTATCTGATATTTTTTAATAG
ATCTGAGCATTTTATAATAATTTTCTATAATATTTTCATCTATTCATAATTTTTT
TAAAGTTTTCTTTAATTCTTGTAAAAATATATTCTTACTTTCATTTTCTTCAATATATT
CTTCTAAAATTAATTTCTTATACAATTCTTTATTCACATATATTAAAGCATTTAATAC
TATTTTTTCTGTTTCTATAGTATCAAATGGTTCCTTAGCATTTTTATAATAATTATTAAA
```

```
                             -continued
TTAATATTTCAGGAAGTACTTTAGAAAAGGATTGGTAAATATTTAATATCATTATTAT
TTTCTTCTGAAATTTTAATATCATTTATTTTAGTAATTATATTTTCTATAGTATCAAAT
ACTACATCTAAATTTAATGCTTTTGACACTTCTTCATCTGATATTTTGGTTTAGAAAAG
TATATTTATGACTTTATTATAGTCATCTTGCGTTCCTTGTAAATCTCTTTGGATTGGTA
TCGCATGTAATATCCTGTTTCTTTCATTTAAACTACATCTAAATTTATATGACTTTATTA
TTATTTGTAATGTTATTTTTATTATCTATAAAATCTAAGTCTCTTTATTATAGTCATCTT
GAATTTAAAATTTTTTTATCAAGTACGTAATTTTTTTTAATATTTCAGGAAGTACTAAA
CTATATTTTCATCAATATTTTCTCTATCATTTAAAATTTTTTATCAAGTTTATTTTTTA
GTAGAAGCAAAAAAAGTAATCAATTCTAAATCCAATTCCTCTTTAGCGTGAAGTCTATT
GAAAAATCATCAGTATTTACTGTTGTCATATCTATATCATTATGTCTTAATTTCCCTAGT
AATACATAATATGCTCTAACGTATATTGCTTATTTTTCCATATCTTTAGAGCGTGATGT
TATACTTTCATTTAAAATTTTTTCAAATTTTTTTATCAAGTACGACTCTTTTTAAAAT
TTGTTCATTTACCAATATTTTTTCAATTCTTCATCAAGTACGTAATTTTTATAATATGCT
ATAGTTCTTTTTCTTCATCAGATTTCTTTGAAAATTTTTTCGAATCAACTAACATATTT
TAATGTTTTTTAAATATTCCAAAAATTTCTGTCTATTTTATATTATCATTTAAAATTTTT
TTCTAATTTTTTTATTAATTCATCTATTTTAAATTCTGATCAGATTTCTTTGAATCTAT
TTTTATACTATTATTTTTTATATTTTCTACAAAAAATTTTCTGTCTATTTTATATTTCTG
TTCTCTTTCTATTTTAAATTTTTCGTGCTTATCTAATAGTACATAAGAACAAAAAATTTTC
TTCTATTTCTTCTCTTTTCAAGAAATTCATTATTAACTTTTTTTTGTTTCTACAAAAAATTT
TAGTAATATTCCAAAATTCTAACTTCTTTTATAACAAAATCAGCTATATCTTCTACTGT
TAAATCTACATTTATATTTAAAATTTTTTCAACAAGCATTTTTTTATTTTTAGATTTCT
TTTTATCACCACCAACATTAAGATAAAATTTTACAAAACCCAGAATTTCTAAATTAC
TTTTTATTTTTTCTCTTATTTCCATTTTTATTTTTAGAAAATTTTACAAAACCCAG
TTCAATAATTTTTCTCTTAAATGTTCTTCATAATATCGATTTTCAAATACTCTTCATAA
TTCATTTTCAATTATTTTTTCTATAATCTTATATAAACTCATGTAATGTTCTTCATAA
TTTCGTAAATTGATTTTTTGTTTCTAATTCATCATTTTCTATTATCTCATGTAATGT
AACAATCATTTAGTGTTTTATTAGTATACTCATCTCTGATATCTATCTCTATTTCTTCT
TCATTCTCTTGTCTCTTTATTTCTATTTTTTTATCATCTTTAGTTATATACTCATCTCTG
GCTTCATCTATTATTTTCTTTTTGTAATCCCCAATGCATAATACAACTTCCCCAATG
ATATGCTTCTATATATAATACAACTTCTTCTGTTTCCAAAAAATCTGTAATCCCCAATGCA
ATTCTTATGATTCCTTCTTTACCTTTCAACTTAAATAGAATATTTCCTGCATGAAATTT
TCTTGTAAATTCTTTAAGAATATTATCATTTTTTTTGTATTATGATTCCTTCTTTACC
ATTTATTATTATCAATTTTTTCTTTATTATTATTATTTTTTTGTATTATGATTCCTT
TTTCCATCATAGTTCCTTTTAACTTTACTTTCCGTTTTTTATTATTATTATTTTTTT
CGAACTTCATACCATCTCTTATGTCCAAATAAATTTCCCATTCCAATCTCCTCGTTTC
TACTTTAATCTAATAAAATATTTTAAATTAAATCAATTTACATCTTTCTAATCAAA
AATACAATTTTCCATTTTTAGTATACCACATATCTCAAAAAAATAAGGAAATAAGAAAA
AGCCGTCAAACATAGCTCCCTACTTCTATTTACTCATAATCCCCATCTATCCTTACTT
TTCGTAAAATCAATCCTTCTTTCGCCTTTAGATCCAACTTAATTTTCCCATCAATATTAA
TGTTCTAAATGTTCTGCCTTCTGTTACCAAATCAATAAATCTTTCATCCTGATAATTT
GTTTCAAATTCCACATTTTCCCAGCTGTTAAACGAATTATTTATTACAACAATAATTA
AATGATCCTCGATTACTCTTTCATACACAATTATTT (SEQ ID NO: 67)
```

Example 3: Further Evaluation of C2c2p and Associated Components

Figure 46:
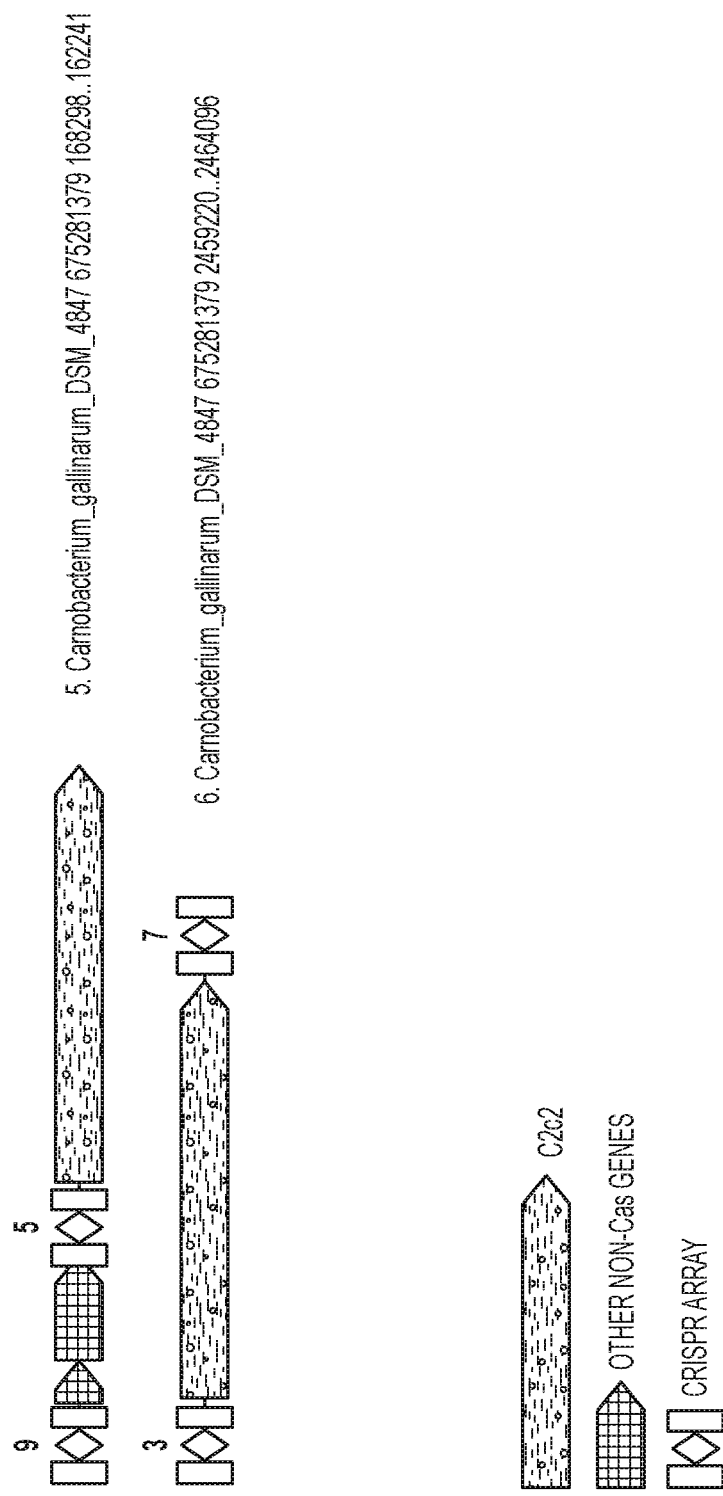
FIG. 46 shows the two C2c2 loci of *Carnobacterium gallinarum*.
Figure 47:
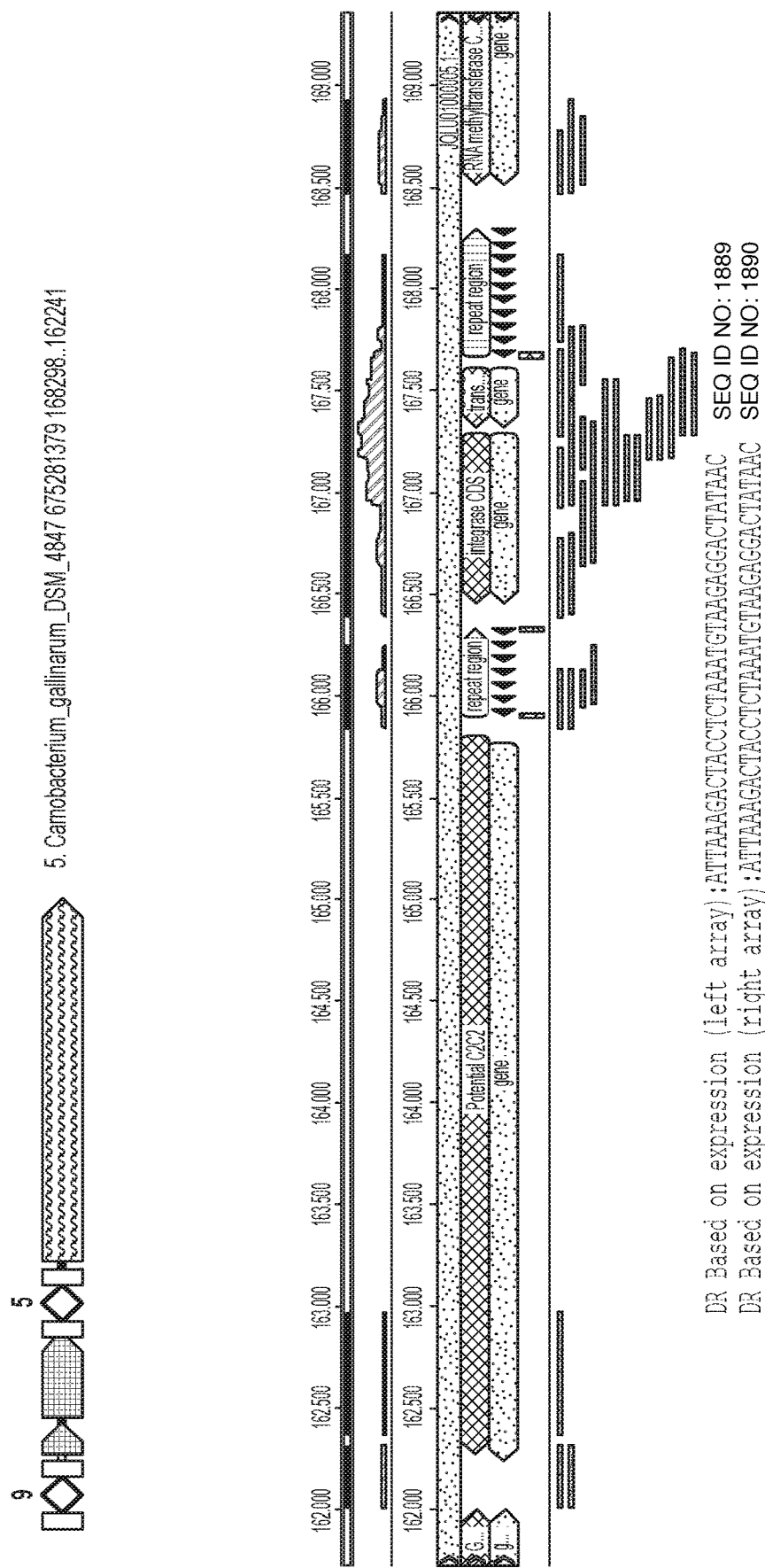
FIG. 47 shows a schematic indicating the expression level of two CRISPR arrays in the direction of the C2c2 gene at the first C2c2 locus. Figure discloses SEQ ID NOS 1889-1890, respectively, in order of appearance.
Figure 48:
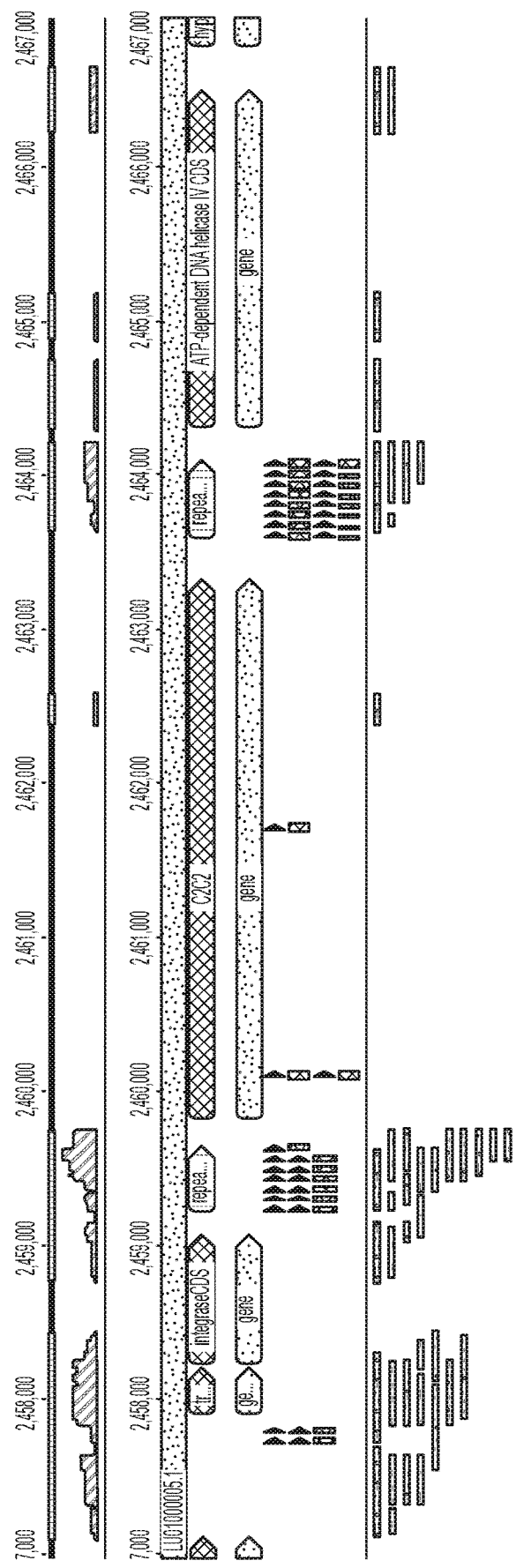
FIG. 48 shows a schematic indicating the expression level of CRISPR arrays with direction of transcription in the direction of the C2c2 gene at the second C2c2 locus. Figure discloses SEQ ID NOS 1891-1892, respectively, in order of appearance.

Applicants isolated both C2c2 loci from *Carnobacterium gallinarum* (FIG. 46) and have studied domain structure and organization as well as expression of the CRISPR array. At the first C2c2 locus, there is low expression of the two CRISPR arrays in the direction of the C2c2 gene. (See FIG. 47). The second locus also has low expression with direction of transcription in the direction of the C2c2 gene. (See FIG. 48). Applicants determined that both loci may have minimal expression since neither locus has associated Cas genes (Cas1/Cas2). Such associated genes may be needed for a functional CRISPR locus. Applicants have optimized methods to obtain C2c2 loci from other bacterial strains.

Applicants perform RNA-sequencing on the following strains that are grown: *Clostridium aminophilum* DSM10710, *Carnobacterium gallinarum* DSM4847, *Leptotrichia wade* F0279, *Leptotrichia shahii* DSM19757, and *Rhodobacter capsulatus* SB1003.

Applicants design pACYC cloning from the following sources of DNA. Applicants clone the entire C2c2 locus into this backbone for DNA/RNA cutting experiments in *E. coli*.
1) Isolated genomic bacterial DNA: *Lachnospiraceae bacterium* MA2020, *Lachnospiraceae bacterium* NK4A179, *Lachnospiraceae bacterium* NK4A144
2) From growing the strain: *Clostridium aminophilum* DSM10710, *Carnobacterium gallinarum* DSM4847, *Leptotrichia wade* F0279, *Leptotrichia shahii* DSM19757, *Rhodobacter capsulatus* SB1003

Applicants design PAM bait libraries for DNA cutting to evaluate the cutting ability of the C2c2p effector protein. Applicants design RNA cutting experiments based on the cutting of a resistance gene transcript.

Applicants test for function in mammalian cells using U6 PCR products: spacer (DR-spacer-DR) (in certain aspects spacers may be referred to as crRNA or guide RNA or an analogous term as described in this application) and tracr for following strains: *Lachnospiraceae bacterium*, *Listeria seeligeri* serovar 12b, *Leptotrichia wadei*, *Leptotrichia shahii*. Applicants mammalian codon optimized the DNA encoding the C2c2 protein and cloned it into a plasmid from Genscript.

Applicants analyzed a representative C2c2 locus, i.e., the *Listeria seeligeri* serovar 1/2b str. SLCC3954 C2c2 (LseC2c2) CRIPSR locus. Applicants performed RNA-sequencing on the *L. seeligeri* C2c2 locus which was cloned into *E. coli*. The LseC2c2 locus was synthesized by Genscript into a pET-28 vector. Cells harboring plasmids were made competent using the Z-competent kit (Zymo). *E. coli* containing heterologous constructs were cultured in Luria broth supplemented with appropriate antibiotics in suspension at 37° C. and 300 rpm. The bacteria were grown in aerobic conditions and harvested in stationary growth phase.

RNA was isolated from stationary phase bacteria by first resuspending the bacteria in TRIzol and then homogenizing the bacteria with zirconia/silica beads (BioSpec Products) in a BeadBeater (BioSpec Products) for 7 one-minute cycles. Total RNA was purified from homogenized samples with the Direct-Zol RNA miniprep protocol (Zymo), DNase treated with TURBO DNase (Life Technologies) and 3' dephosphorylated with T4 Polynucleotide Kinase (New England Biolabs). rRNA was removed with the bacterial Ribo-Zero rRNA removal kit (Illumina). RNA sequencing libraries were prepared from rRNA-depleted RNA using a derivative of the previously described CRISPR RNA sequencing method (Heidrich et al., 2015, Methods Mol Biol, vol. 1311, 1-21). Briefly, transcripts were poly-A tailed with *E. coli* Poly(A) Polymerase (New England Biolabs), ligated with 5' RNA adapters using T4 RNA Ligase 1 (ssRNA Ligase), High Concentration (New England Biolabs), and reverse transcribed with AffinityScript Multiple Temperature Reverse Transcriptase (Agilent Technologies). cDNA was PCR amplified with barcoded primers using Herculase II polymerase (Agilent Technologies).

The prepared cDNA libraries were sequenced on an MiSeq (Illumina). Reads from each sample were identified on the basis of their associated barcode and aligned to the appropriate RefSeq reference genome using BWA (Li and Durbin, 2009, Bioinformatics, vol. 25, 1754-1760). Paired-end alignments were used to extract entire transcript sequences using Picard tools (github.io/picard) and these sequences were analyzed using Geneious 8.1.5.

Figure 49A:
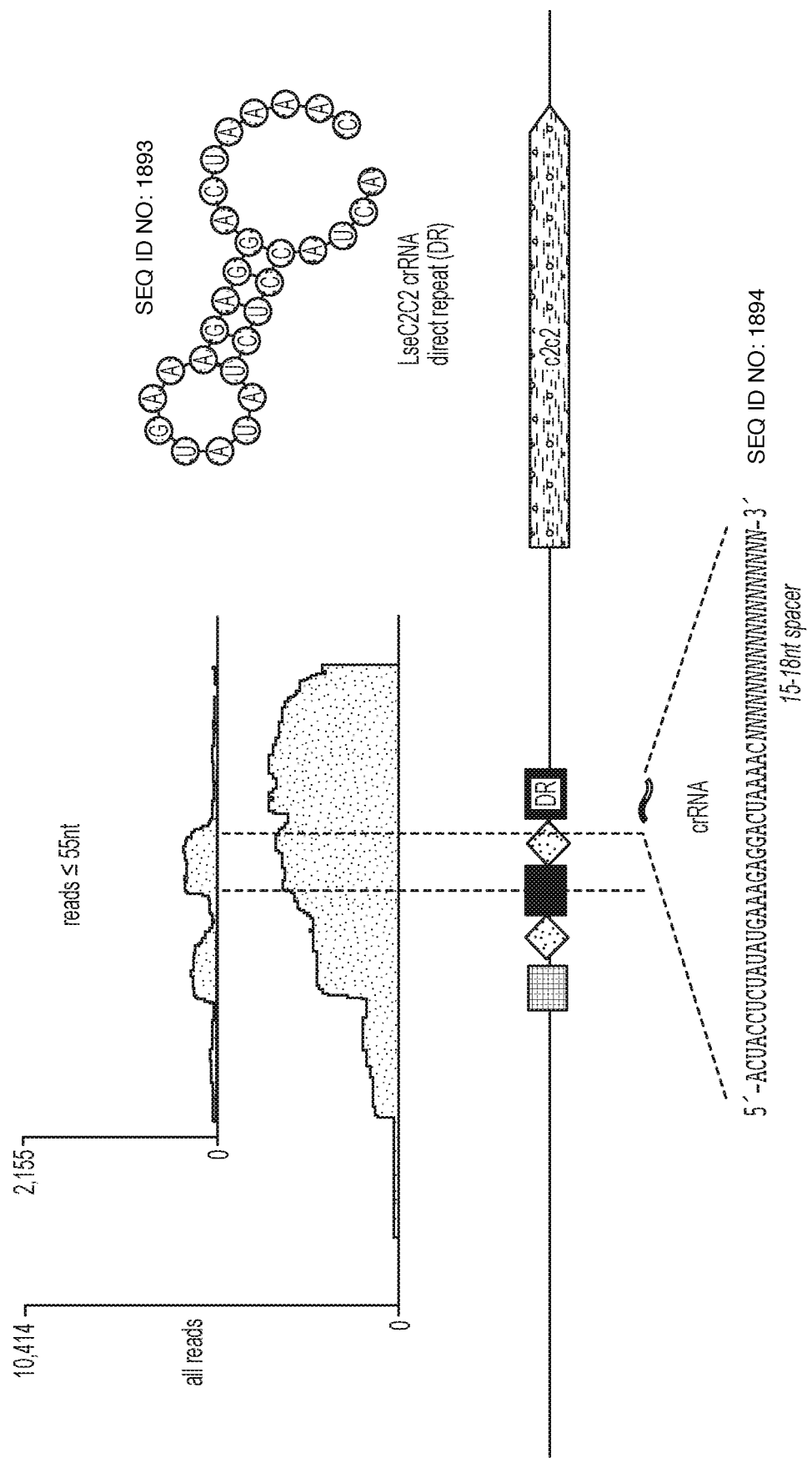
FIG. 49A-49B.

The Applicants observed a high level of expression of the locus and the formation of small crRNAs with a 5' 29-nt DR and 15-18-nt spacers (FIG. 49A). Although the LseC2c2 locus contains a predicted putative tracrRNA (FIG. 15), the Applicants did not observe its expression (FIG. 49A). These findings suggest that the secondary structure present in the pre-crRNA of the LseC2c2 locus could be sufficient for processing yielding the mature crRNA as well as crRNA loading onto the C2c2 protein. The RNA-folding of the processed crRNA shows a strongly predicted stem loop within the direct repeat that potentially could serve as a handle for the C2c2 protein (FIG. 49A).

Figure 49B:
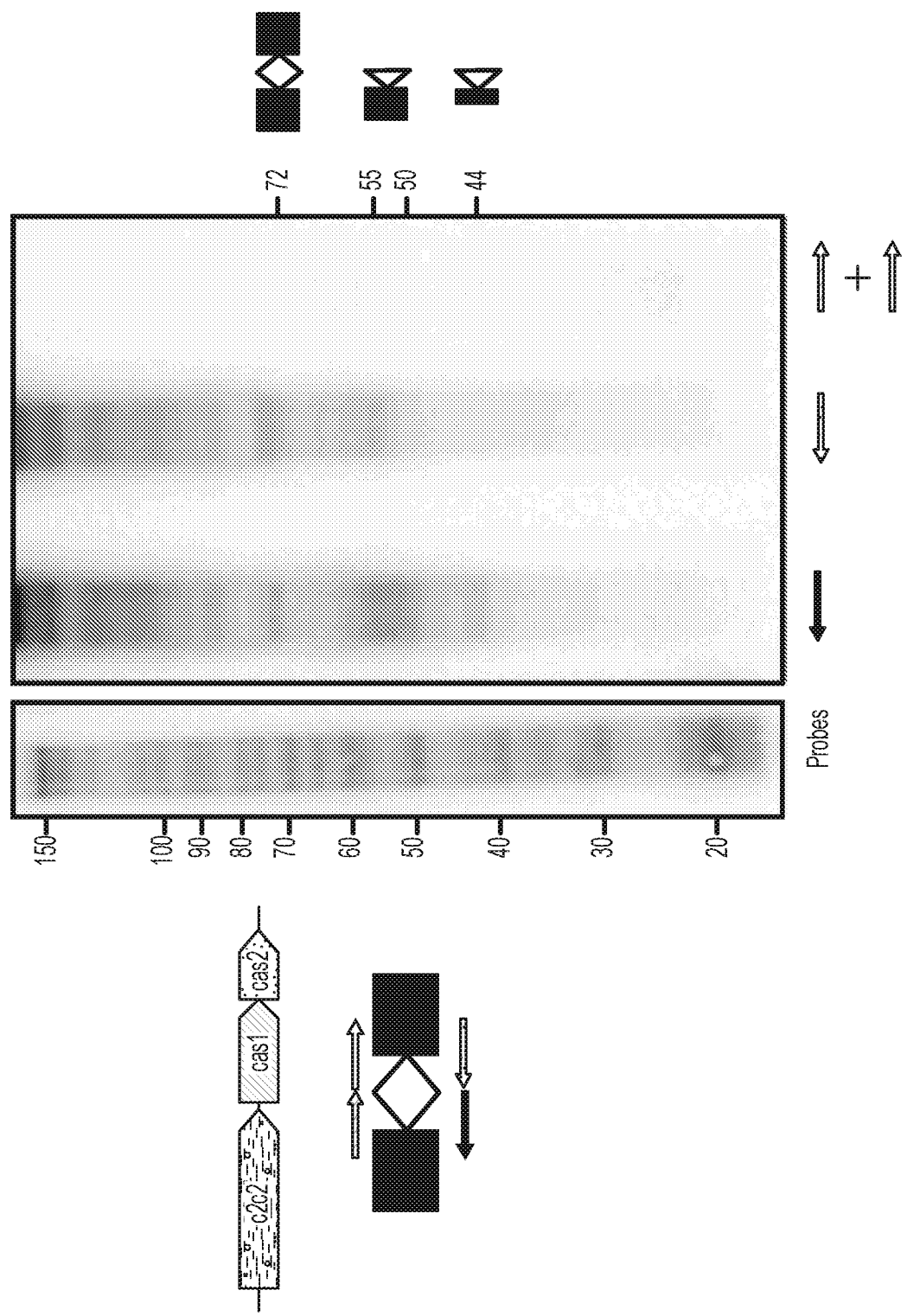
Figure 50A:
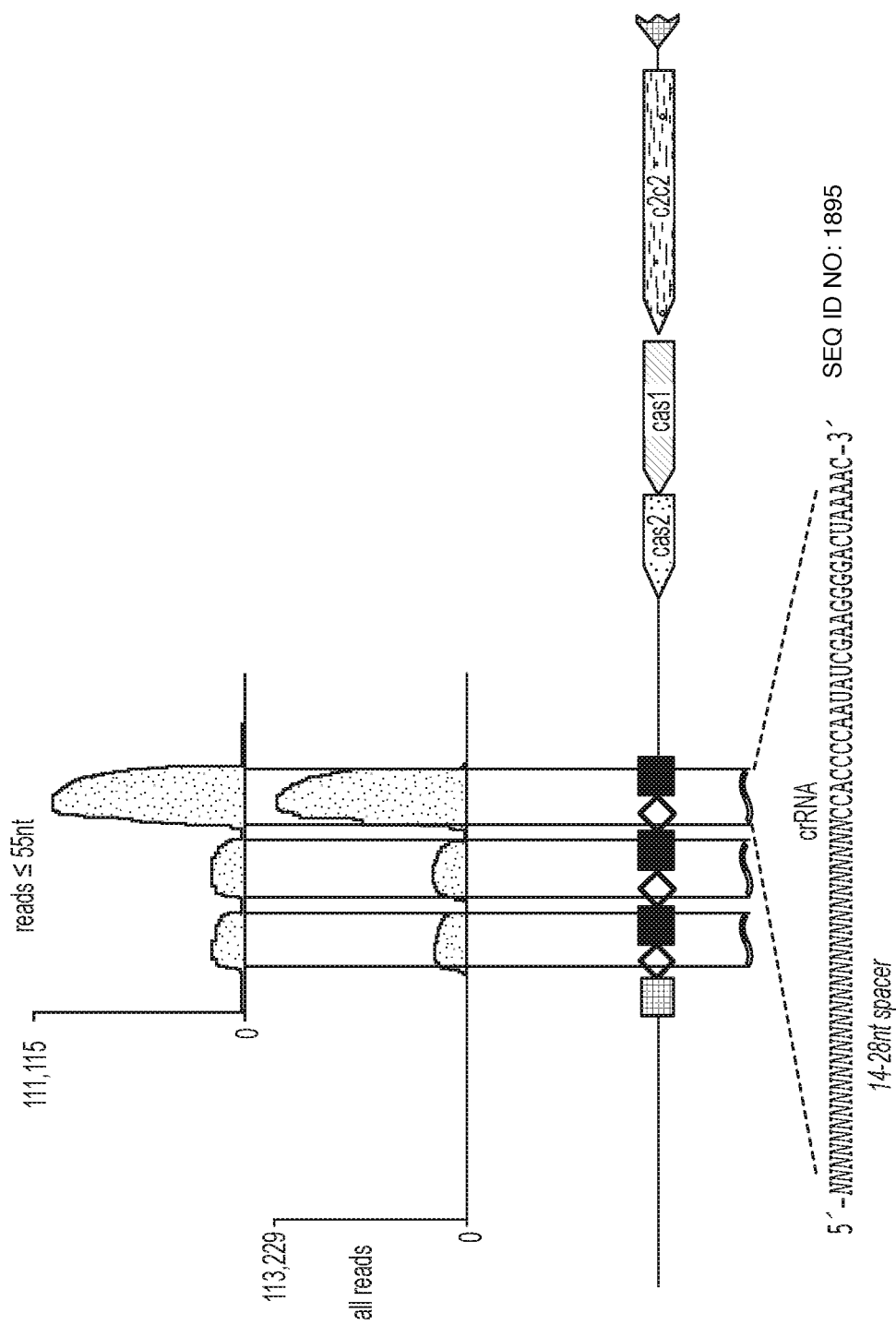
FIG. 50A-50C.
Figure 50B:
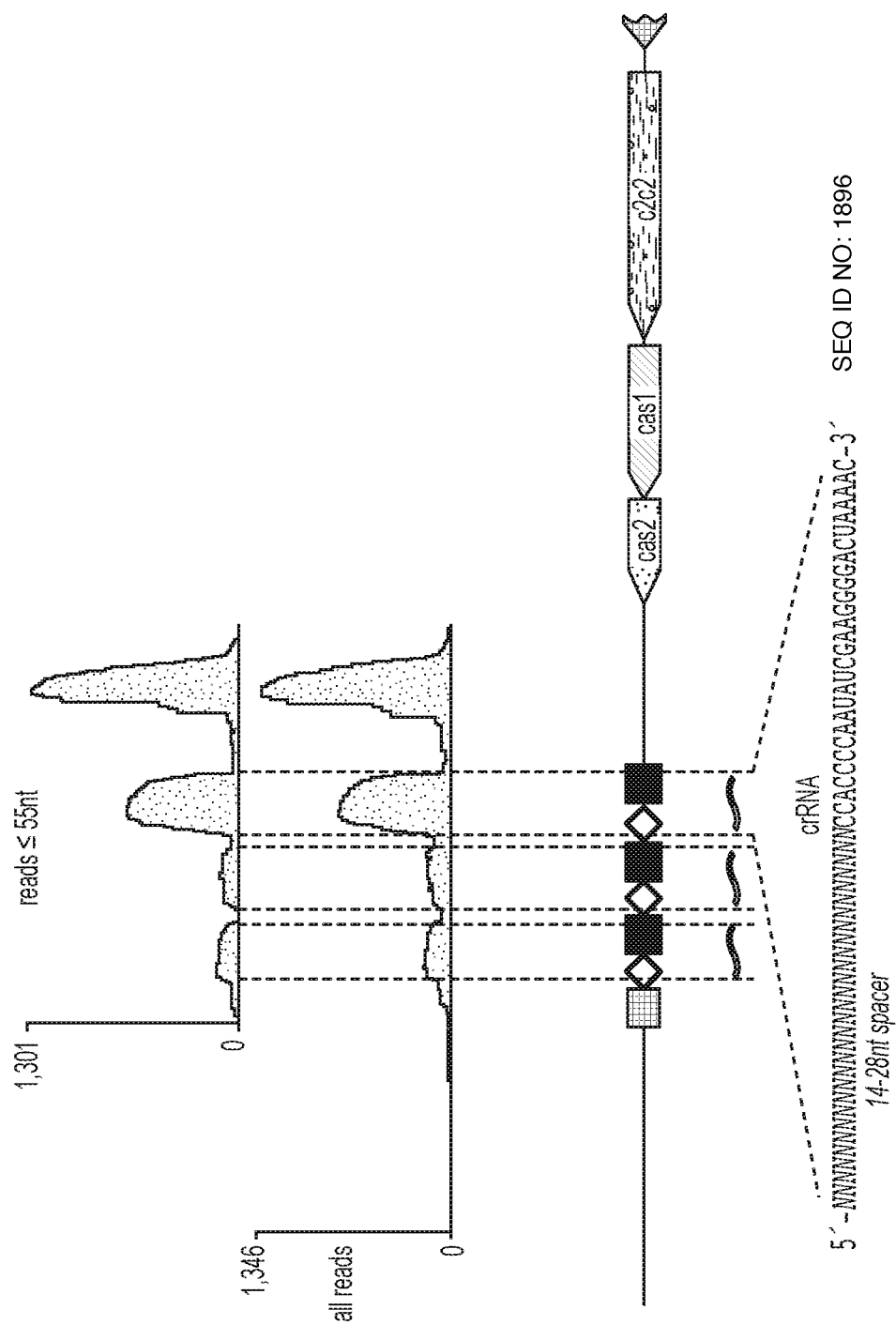
Figure 50C:
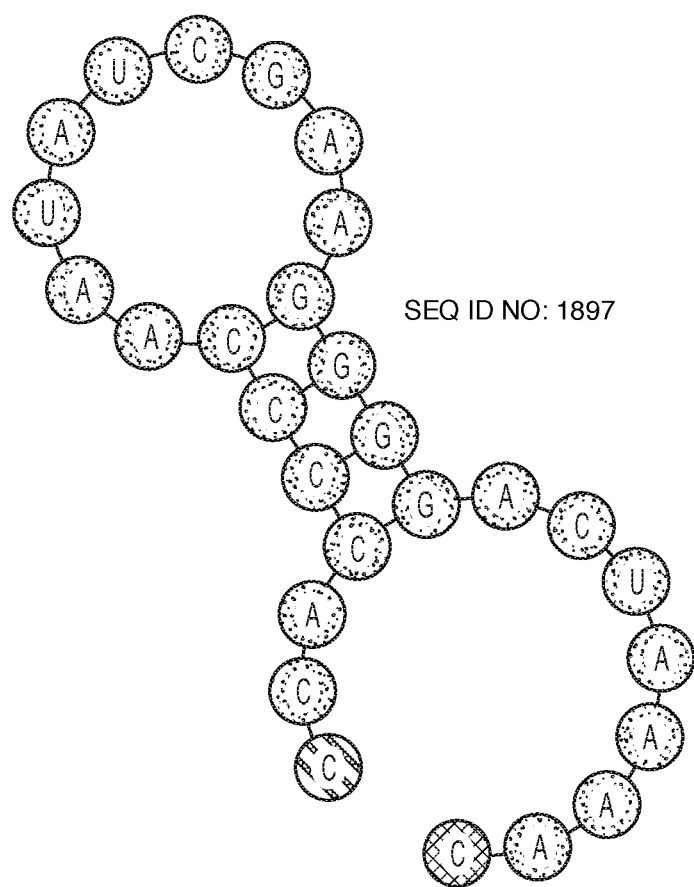

The Applicants also expressed the *Leptotrichia shahii* str. SLCC3954 C2c2 locus in *E. coli* and analyzed its expression using Northern blotting. The procedure was performed essentially as described in Pougach and Severinov, 2012 (Methods Mol Biol, vol. 905, 73-86). *E. coli* BL21 AI cells were transformed with the plasmid pACYCduet-1 containing under inducible T7 promoter *Leptotrichia shahii* cas operon and plasmid pCDF-1b containing the minimal CRISPR cassette with a single spacer. Total RNA was extracted from 5 mL of *E. coli* cells induced with 1 mM arabinose/0.2 mM IPTG and grown until $OD_{600}$ 0.8-1.0. The cells were lysed by 5-minute treatment using Max Bacterial Enhancement Reagent followed by RNA purification with the TRIzol reagent (Thermo Fisher Scientific). 15 µg of total RNA were separated on a denaturing 8 M urea—12% polyacrylamide gel and electrophoretically transferred to Hybond-XL membrane (GE Healthcare) using a Mini Trans-Blot Electrophoretic Transfer Cell (Bio-Rad). The membrane was dried and then UV cross-linked. ExpHyb hybridization solution (Clontech) was used for hybridization according to manufacturer's instructions for 1 hour at 40° C. with $^{32}$P-end labeled oligonucleotide probes. The Applicants found that the CRISPR array is expressed and processed into 44-nt crRNAs (FIG. 49B). The expression and crRNA formation was thus demonstrated herein in at least two distinct C2c2 loci using independent methods.

The Applicants sought to predict potential tracrRNAs for the rest of the identified C2c2 loci by searching for anti-repeat sequences within each locus. In many CRISPR-Cas loci, the repeat located at the promoter-distal end of the CRISPR array is degenerate and has a sequence that is clearly different from the rest of repeats (Biswas et al., 2014, Bioinformatics, vol. 30, 1805-1813). Such degenerate repeats were detected in several C2c2 and C2c1 systems, allowing the Applicants to predict the direction of the array transcription. By integrating this information, putative tracrRNAs for 4 of the 17 C2c2 loci and 4 of the 13 C2c1 loci were identified. In some subtype II-B and II-C loci, the CRISPR array is transcribed in the opposite direction, starting from the degenerate repeat (Sampson et al., 2013, Nature, vol. 497, 254-257; Zhang et al., 2013, Mol Cell, vol. 50, 488-503). Accordingly, we attempted to predict the tracrRNA in different positions with respect to the CRISPR array but were unable to identify additional candidate tracrRNA sequences. Conceivably, the prediction of tracrRNA for other loci was hampered by a combination of factors such as imperfect complementarity to repeats, lack of an associated CRISPR array, and/or potential incompleteness of the loci. Furthermore, the possibility remains that not all Class 2 CRISPR systems require tracrRNA.

Figure 54:
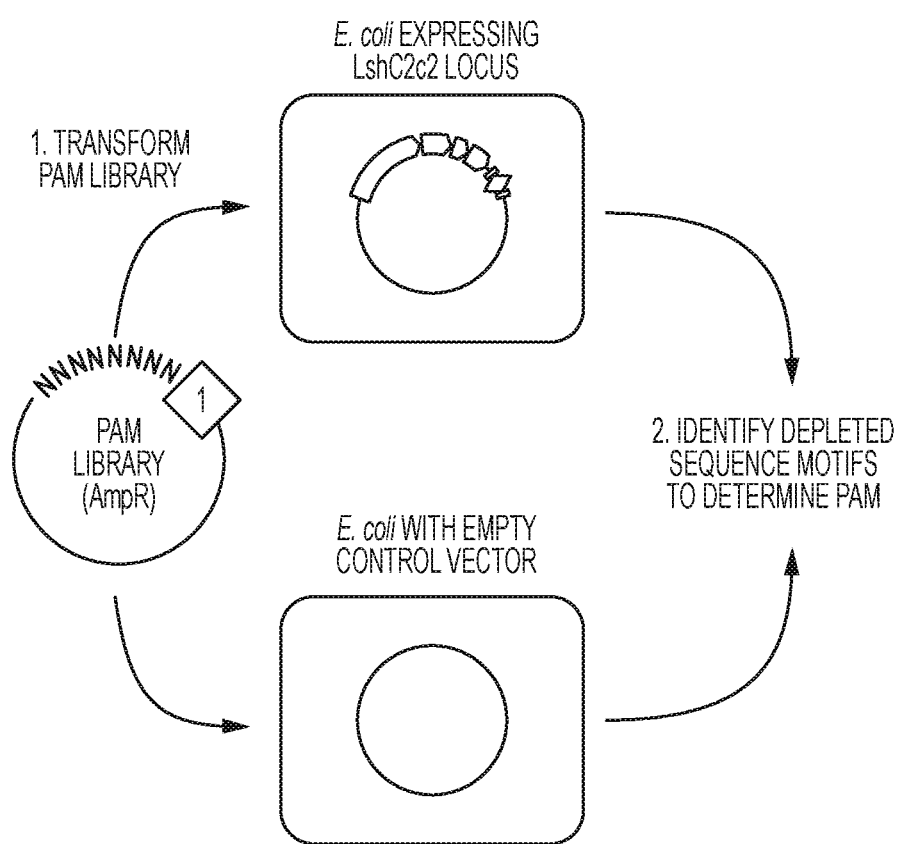
FIG. 54 is a cartoon depicting in vivo experiment using *E. coli* expressing LshC2c2 to identify depleted sequence motifs. A PAM library conferring ampicillin resistance is transferred into *E. coli*. Plasmids carrying sequence motifs containing a PAM determinant are lost and unable to confer ampicillin resistance. PAM sequence motifs are identified by their depletion.
Figure 56:
FIG. 56 depicts targeting of an endogenous target in *E. coli*. Interference is indicated by a reduction in colony forming units (cfu) pre 20 ng of plasmid. Interference was observed in *E. coli* carrying LshC2C but not with a control pACYC184. Increased interference is associated with a transcribed target.
Figure 83:
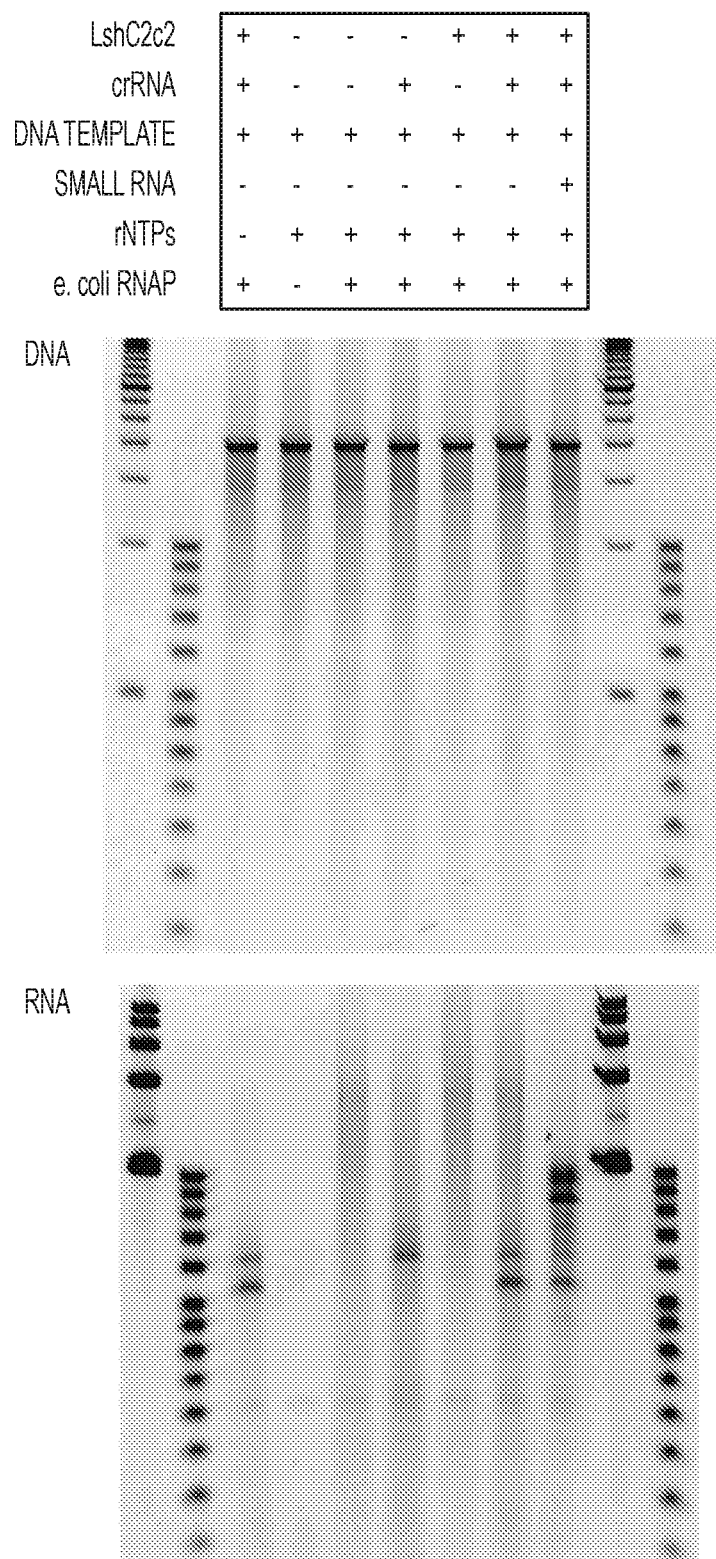
FIG. 83 demonstrates that LshC2c2 does not cleave untranscribed or transcribed DNA in an E. coli RNAP in vitro assay. Assay set-up as described in Samai et al. (Cell, 2015). 200 bp target is used (corresponding to RNA target of FIG. 82). 1 h incubation at 37° C. for concurrent transcription and cleavage after open complex formation.
Figure 84:
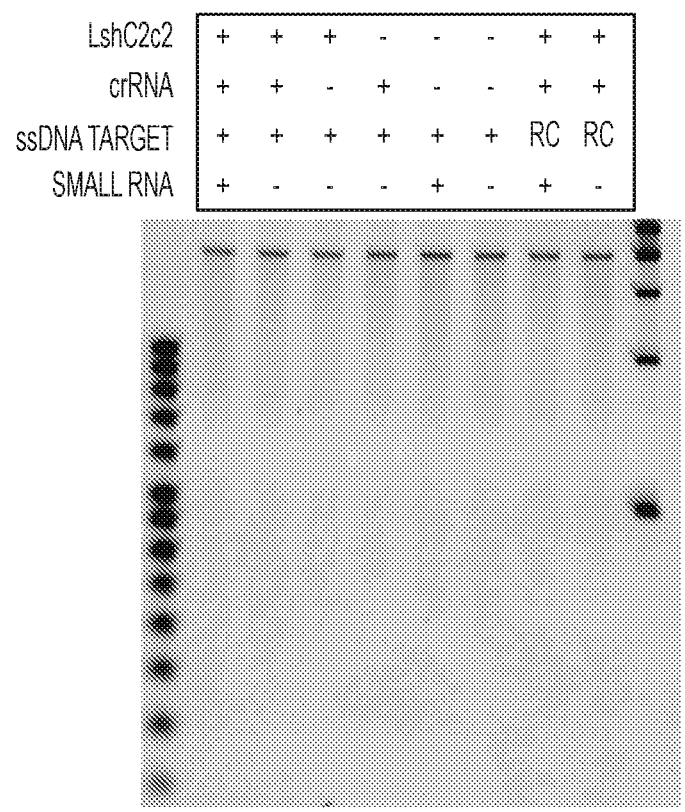
FIG. 84 demonstrates that LshC2c2 does not cleave ssDNA in vitro. 1 h incubation at 37° C., ssDNA version of t3 G-PAM and its reverse complement (RC).
Figure 85A:
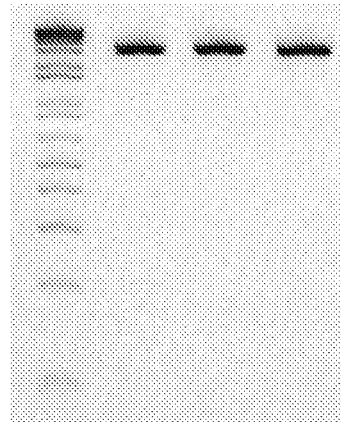
FIG. 85A-85B demonstrates that C2c2 does not cleave dsDNA (FIG. 85A) and ssDNA (FIG. 85B). Band gel extracted and prepared for next generation sequencing by Illumina MiSeq.
Figure 85B:
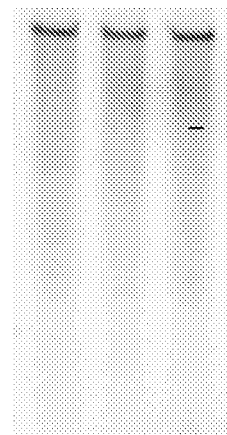

The Applicants identified depleted sequence motifs in order to identify PAM nucleotides. A PAM library was prepared in a bacterial vector and transformed into a strain of *E. coli* expressing LshC2c2 (FIG. 54). In further detail, the assay is as follows for a RNA target, provided that a PAM sequence is required to direct recognition. Two *E. coli* strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the RNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12h after transformation, all colonies formed by the test and control strains where harvested and plasmid RNA was isolated. Plasmid RNA was used as template for PCR amplification and subsequent deep sequencing. Representation of all PAMs in the untransformed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM. CRISPR interference results in ineffective transformation by plasmids containing an effective target sequence. Transformant plasmids were sequenced to identify non-target sequences. Depleted sequences identify the 5' PAM nucleotides (FIG. 55). Heterologous targeting in *E. coli* was observed for three targets. Increased interference was observed for more highly transcribed targets. In particular, a target in a transcribed region ("RNA") coincided with increased interference compared to minimally transcribed target "DNA1" and "DNA2" (FIG. 56). A 5' DNA PAM screen showed no DNA cleavage (FIG. 85A-85B). LshC2c2 does not cleave untranscribed or transcribed DNA in an *E. coli* RNAP in-vitro assay (FIG. 83). LshC2c2 does not cleave ssDNA or dsDNA in vitro (FIG. 84).

Figure 58:
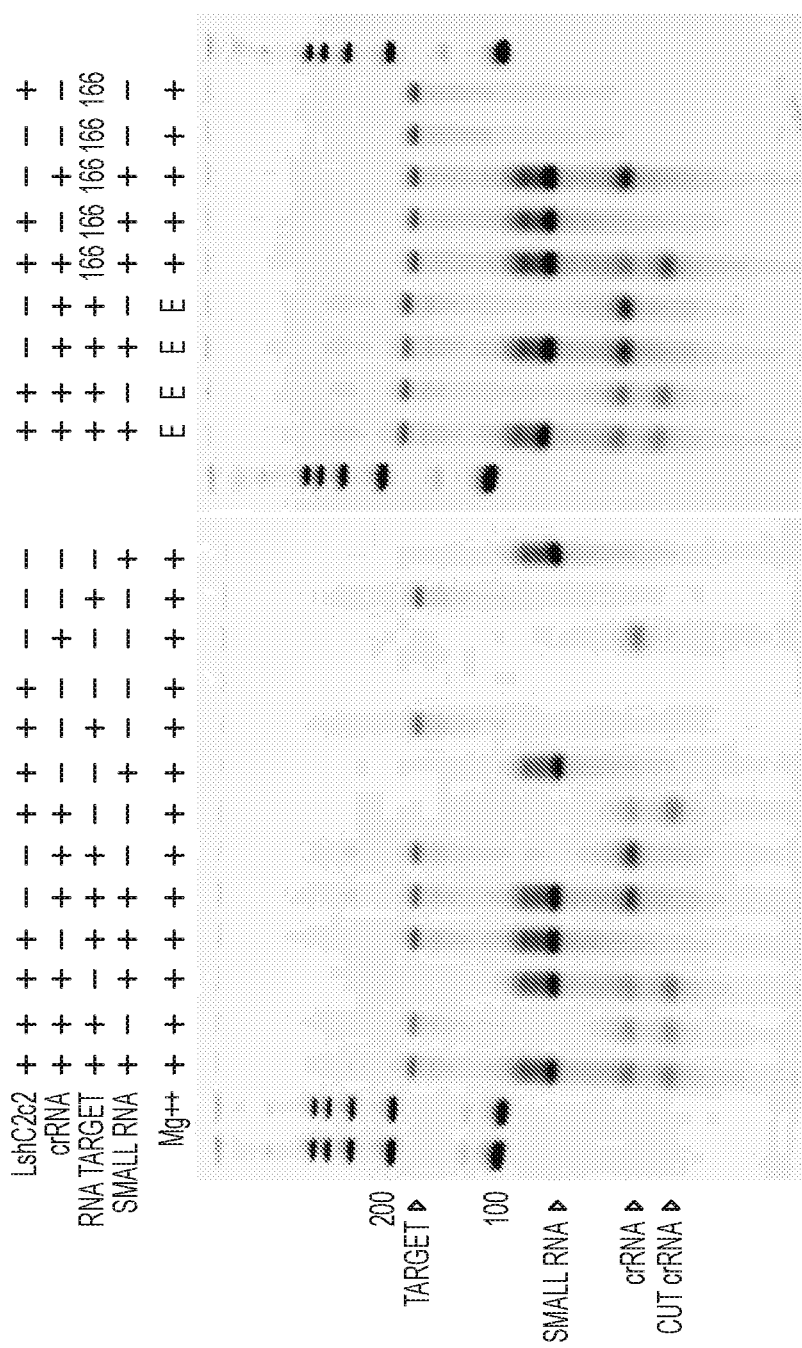
FIG. 58 depicts components of in vitro experiments with purified Lsh C2c2 and FPLC purified RNA target. Component "166" indicates a non-complementary target. "E" indicate EDTA. Cleavage of crRNA is observed when present with C2c2.
Figure 59:
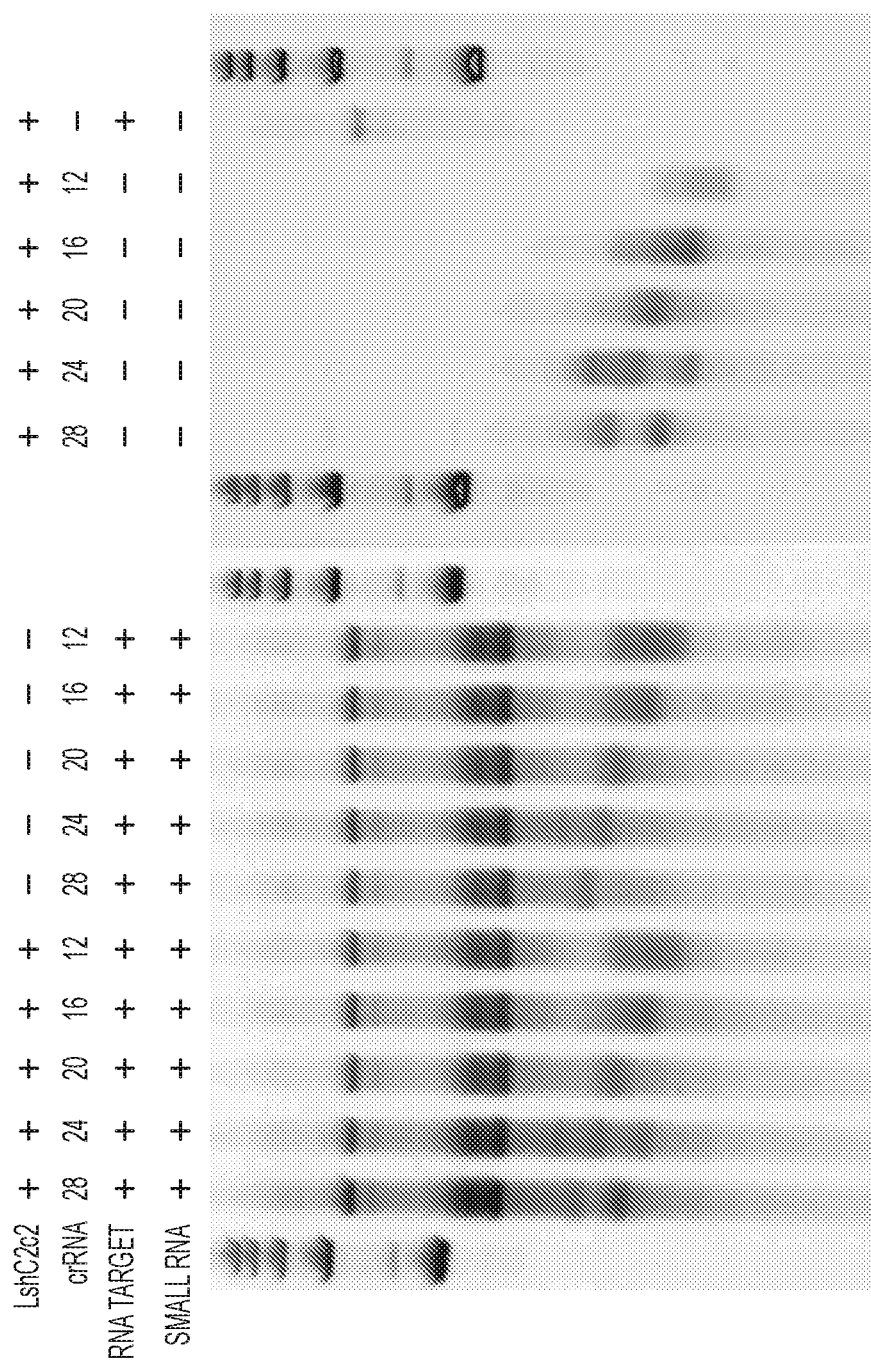
FIG. 59 depicts in vitro experiments with purified C2c2, RNA target and crRNAs with spacer lengths of 12-26 nucleotides. Cleavage of crRNAs with 28 or 24 nt spacers is observed.
Figure 60:
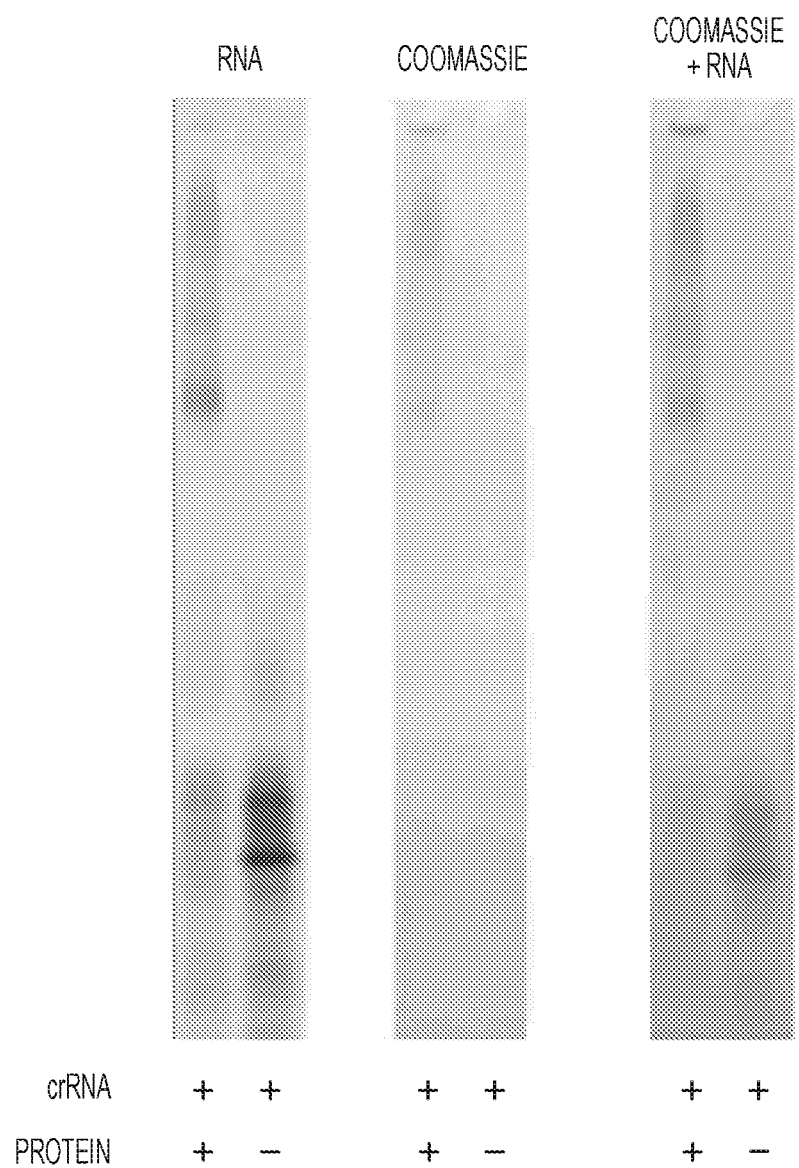
FIG. 60 depicts an electrophoretic mobility shift assay (EMSA) useful to detect protein complexes with nucleic acids.
Figure 108:
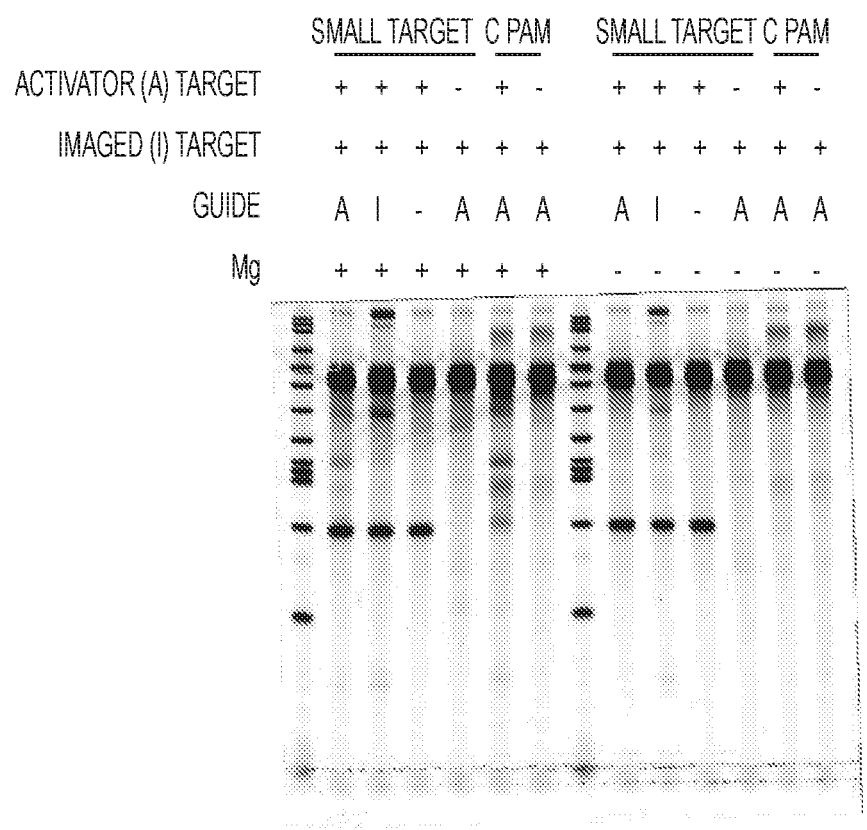
FIG. 108 shows bystander effect. Reduced cleavage is observed in absence of magnesium.

LshC2c2 components were purified for in vitro tests (FIG. 57). Initially, it was observed in test reactions that crRNA is cleaved by C2c2. Cleavage of crRNA is not $Mg^{2+}$ dependent, and may be elevated in the absence of target (FIG. 58). It was further found that there is reduced cleavage in absence of Mg (FIG. 108)

Figure 61:
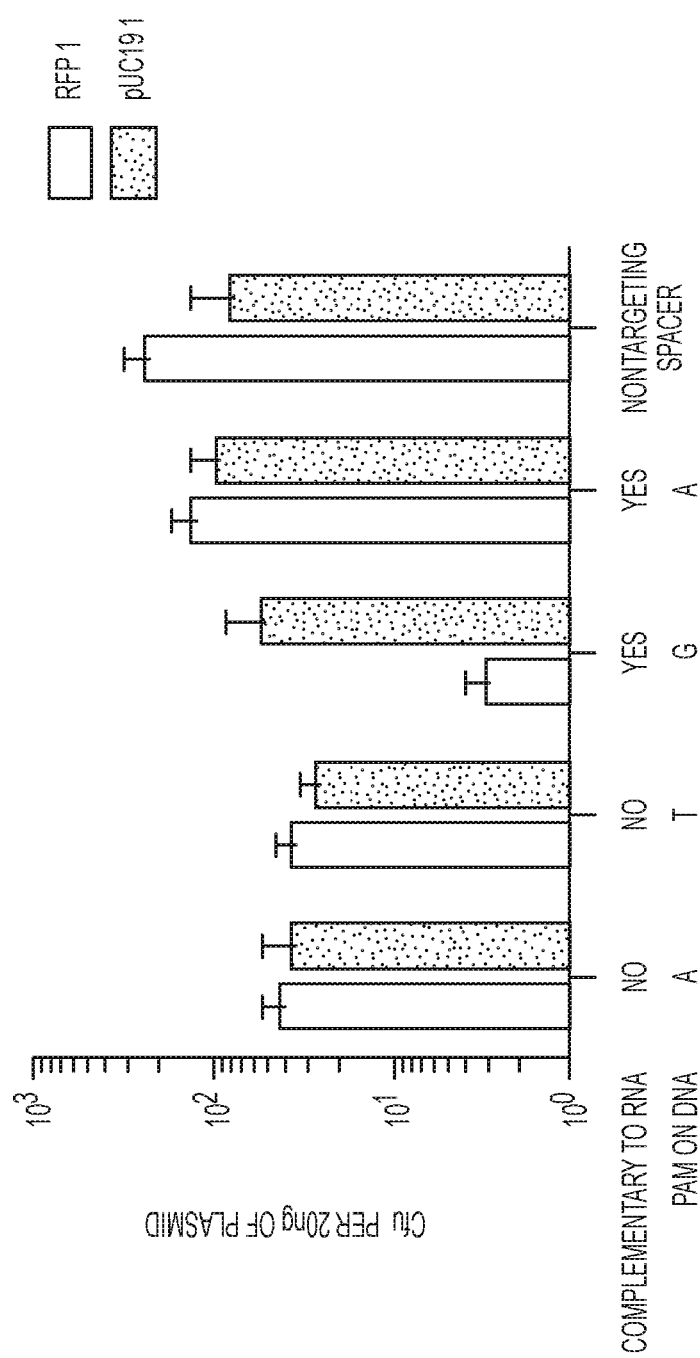
FIG. 61 depicts targeting in vivo of transcribed red fluorescent protein (RFP) using RFP spacers matching or complementary to RNA. Spacers targeting transcribed RFP were cloned into the Lsh C2c2 locus followed by expression in *E. coli* carrying a plasmid expressing RFP or a pUC19 plasmid control. Interference was determined on the basis of colony forming units (cfu) per 20 ng of transformed plasmid.
Figure 62:
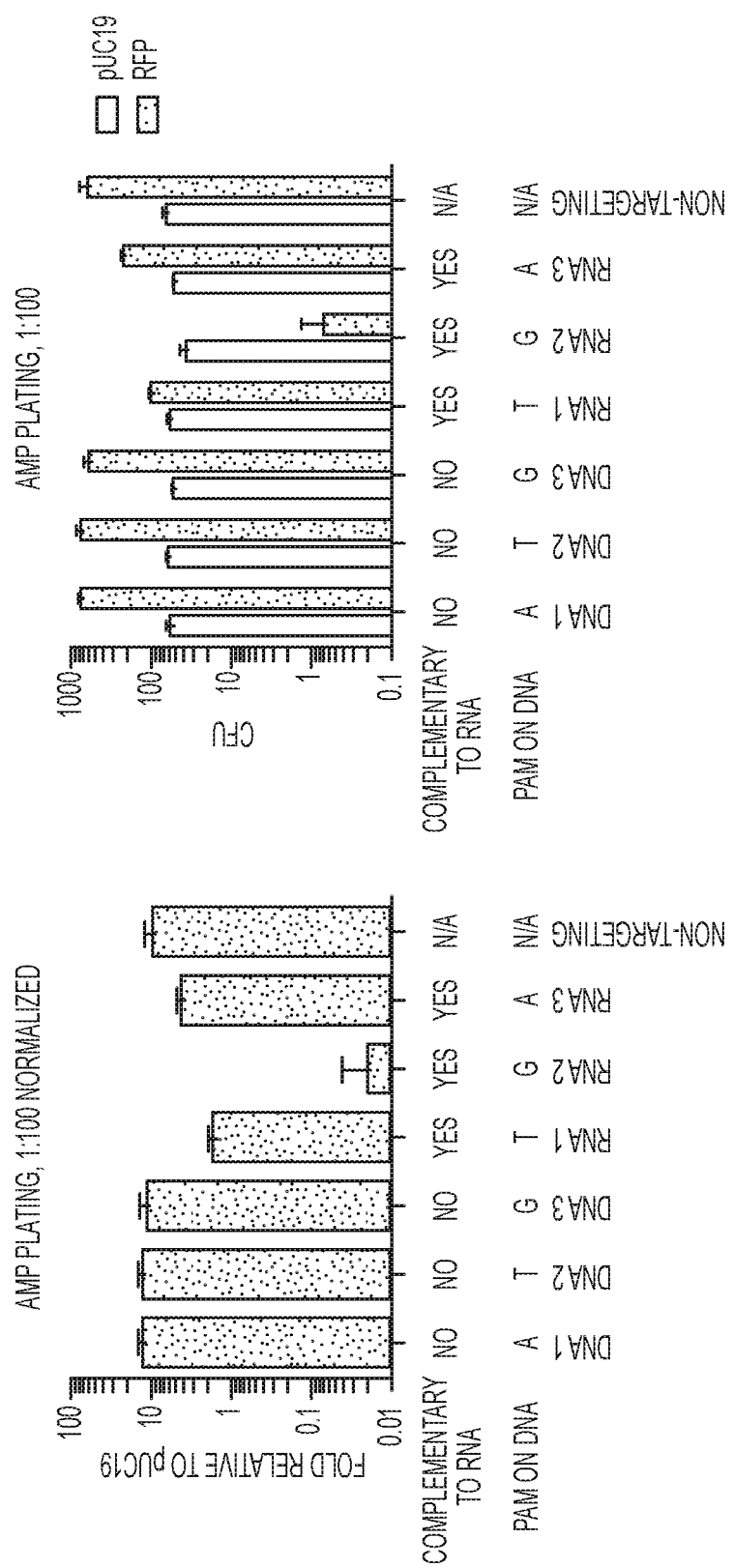
FIG. 62 depicts strand-dependent interference with plasmid carrying an RFP target. Interference was measured as colony forming units (cfu) for 6 RFP targets (left panel). Interference was observed to depend on the strand targeted and the PAM nucleotide present. Interference with non-targeted pUC19 control plasmid was not observed (right panel).
Figure 63A:
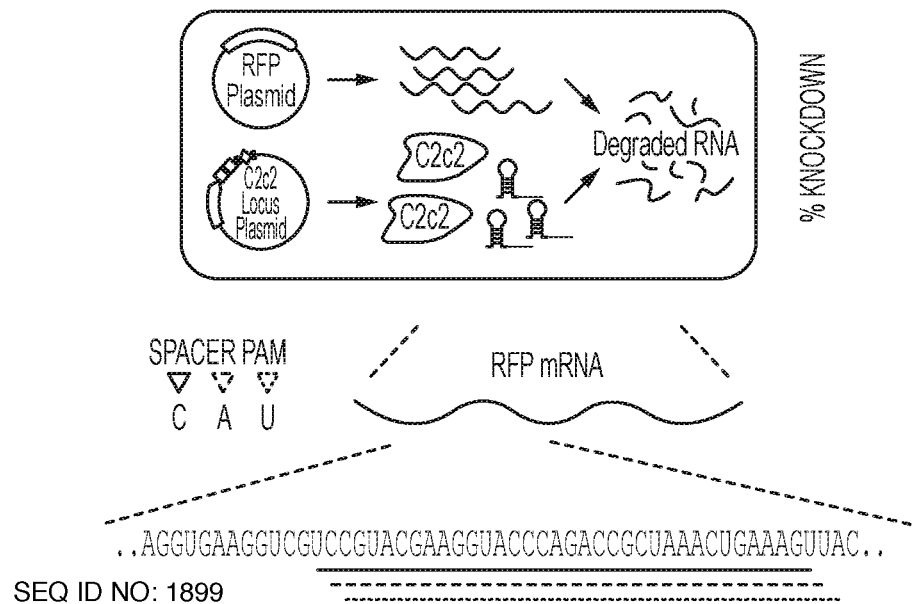
FIG. 63A-63C.
Figure 63B:
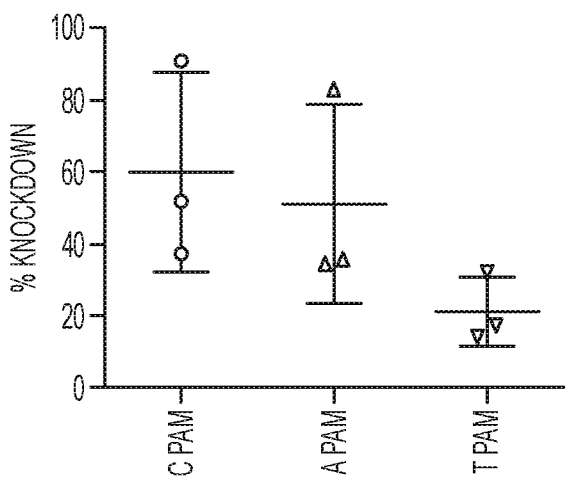
Figure 63C:
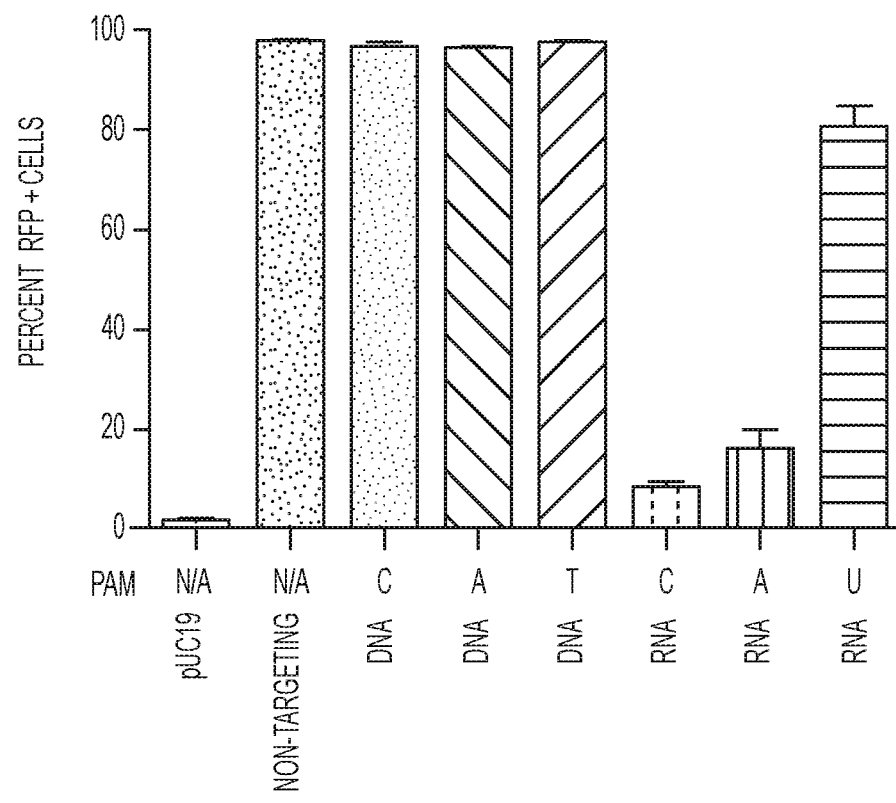
Figure 64:
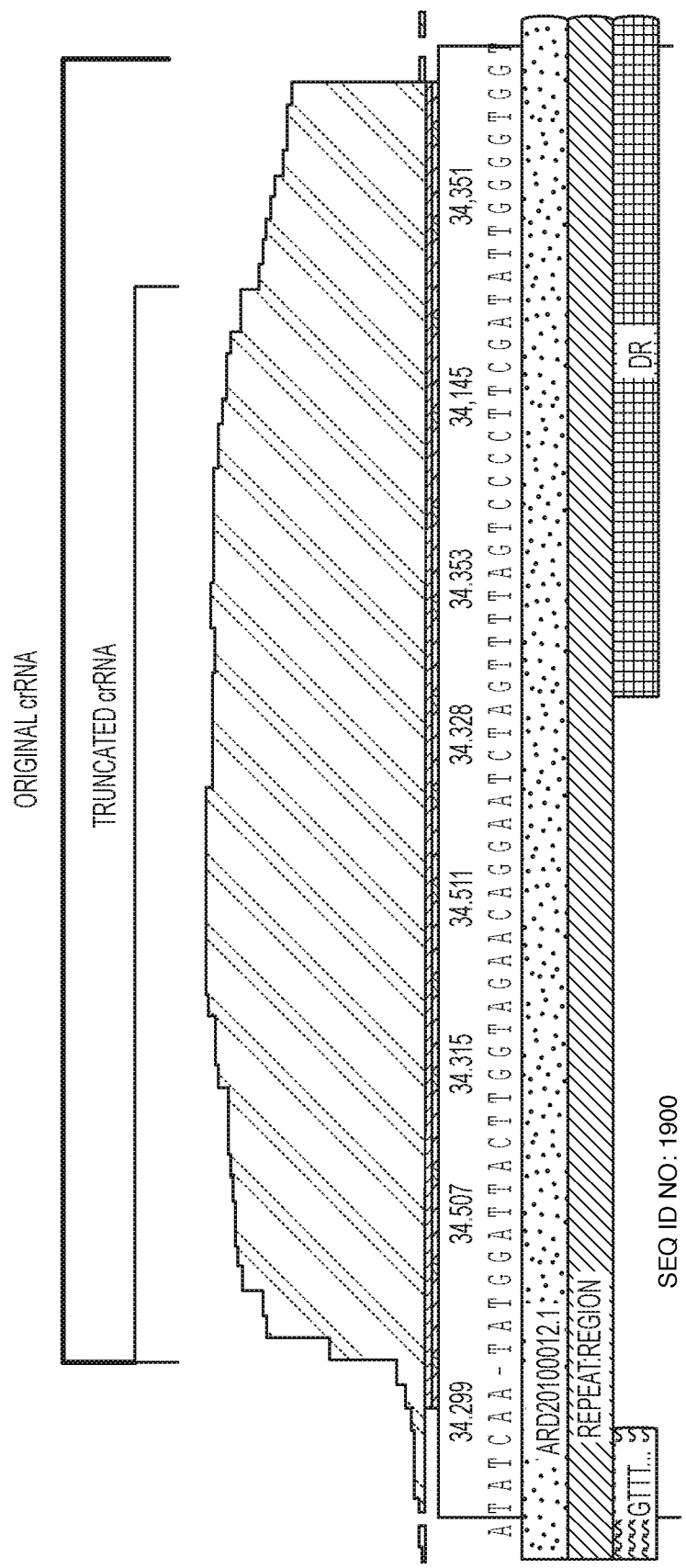
FIG. 64 depicts processing of direct repeat (DR) sequences by LshC2c2. LshC2c2 processes the DR on the 5' end. Figure discloses SEQ ID NO: 1900.

After showing the capability of the LshC2c2 CRISPR locus to mediate ssRNA interference, we wanted to demonstrate two additional aspects of C2c2 activity: 1) RNA interference using an orthogonal assay, and 2) the ability to retarget C2c2 to endogenously expressed transcripts in a cell. We developed a fluorescent readout for LshC2c2 activity by expressing RFP from a transfected plasmid in *E. coli* (FIG. 63A). We then designed three spacers for each of the three possible H PAMs (9 spacers total) targeting the RFP mRNA and cloned them into the pLshC2c2 backbone as before. We transfected these plasmids into *E. coli* already expressing the RFP plasmid and grew them under double selection over night. By analyzing the RFP levels in *E. coli* by flow cytometry, we observed robust RFP knockdown for all three PAMs and no RFP knockdown for spacers targeting the anti-sense DNA strand or non-targeting spacers (FIG. 63A-63C). To further investigate LshC2c2 targeting and cleavage activity, spacers targeting RFP were cloned into the LshC2c2 locus and the locus was expressed in *E. coli* carrying a plasmid encoding expressible RFP or a pUC19 control plasmid. FIG. 61 shows C2c2 targeted the transcribed RFP. Strand-dependency of interference was investigated by selecting target sequences coinciding with or complementary to transcribed regions. High levels of interference were observed using targeting sequences complementary to transcribed RNA (FIG. 62). The extent of interference was also observed to vary among transcribed targets, possibly in relation to transcription levels (FIG. 63A-63C).

Figure 65:
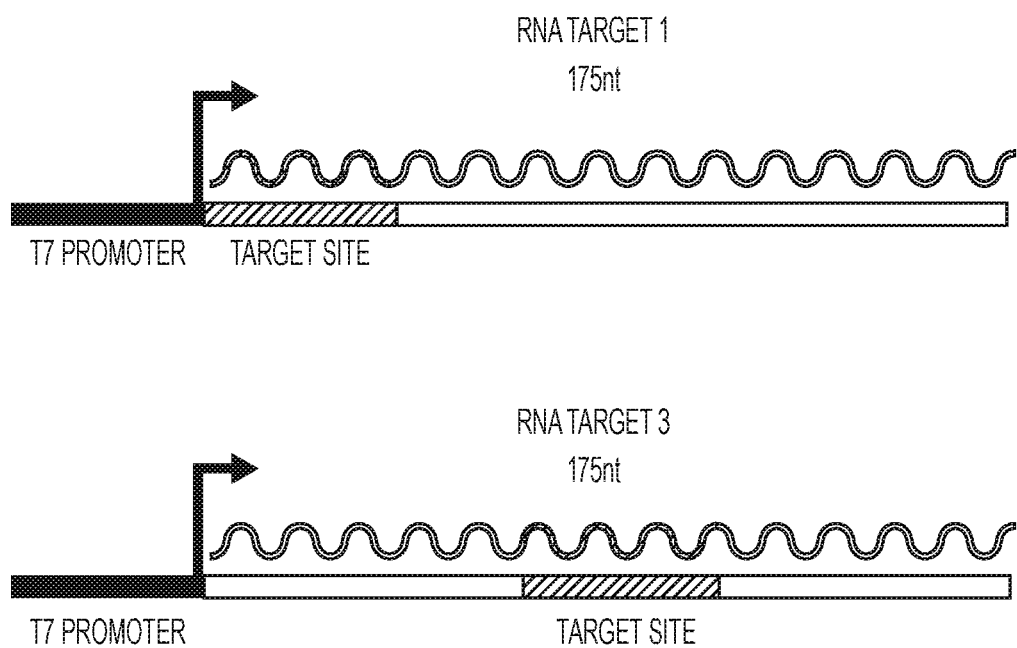
FIG. 65 depicts strategy for investigating target site selection. Target 1 (T) contains a G PAM, Target 3 (T3) contains a C PAM.
Figure 66:
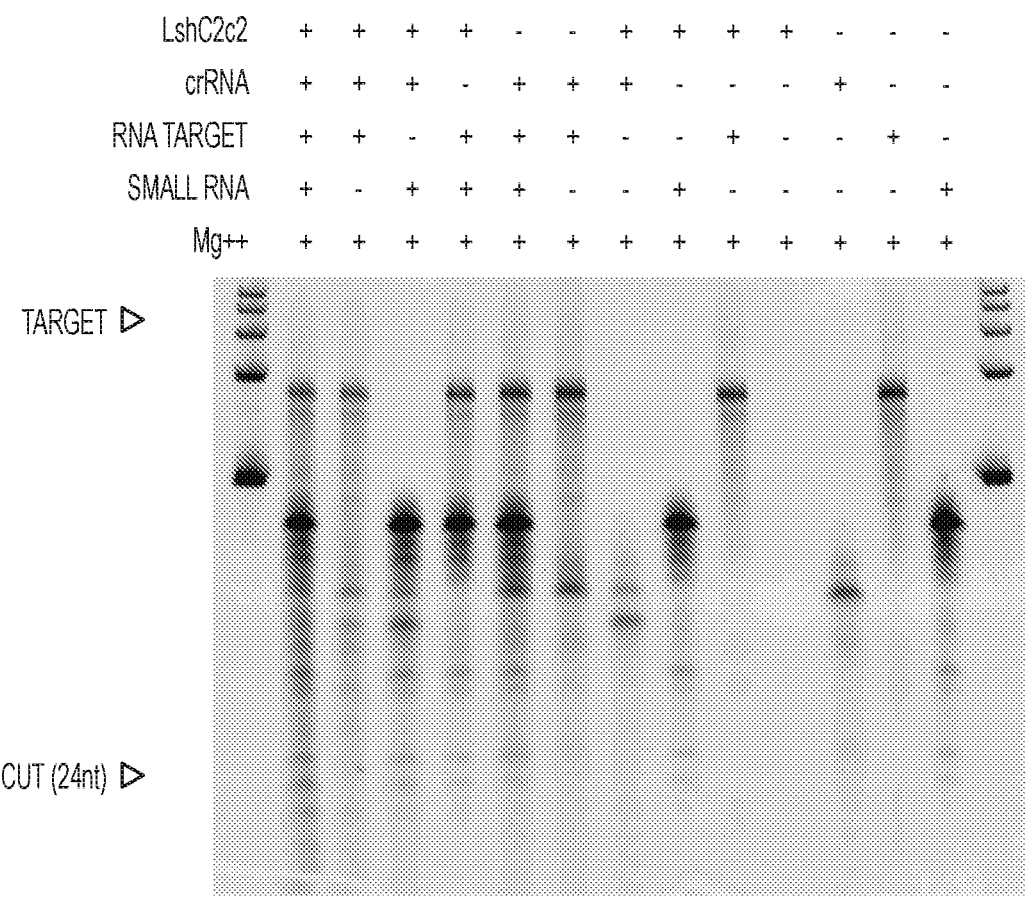
FIG. 66 depicts results of a C2c2 RNA cleavage reaction targeted to T3 (see FIG. 65). Reaction components are indicated.
Figure 67:
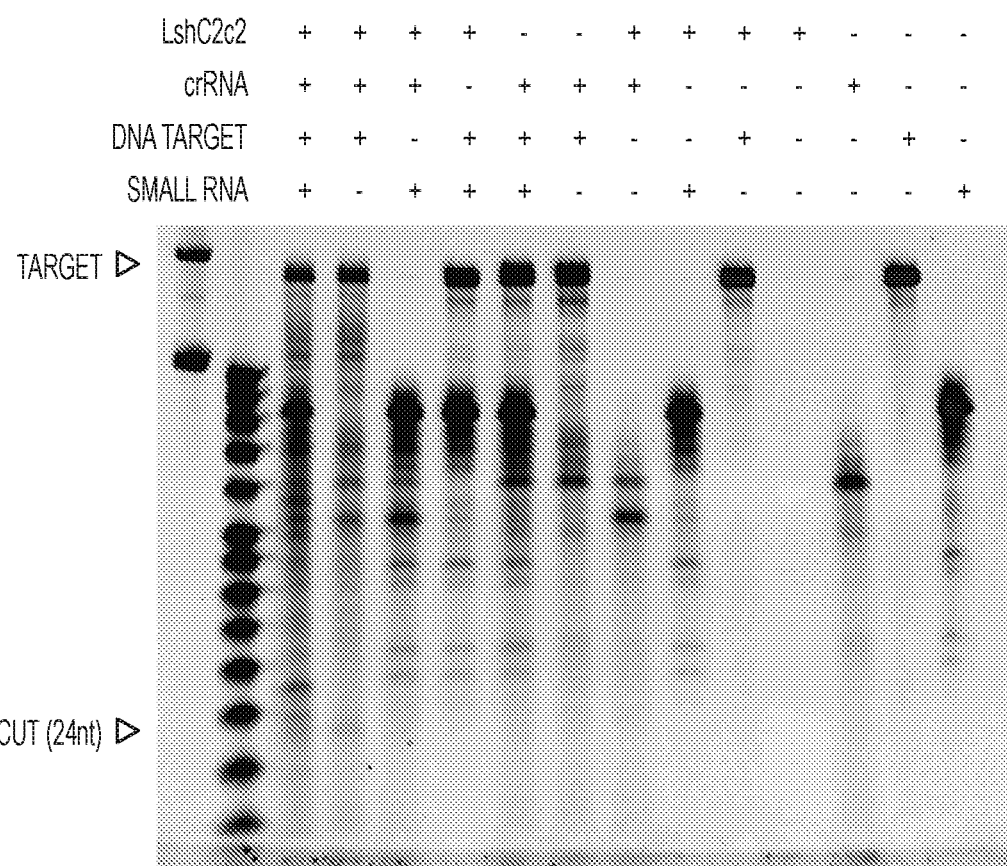
FIG. 67 depicts results of a C2c2 RNA cleavage reaction targeted to T1 (see FIG. 65). Reaction components are indicated.
Figure 68:
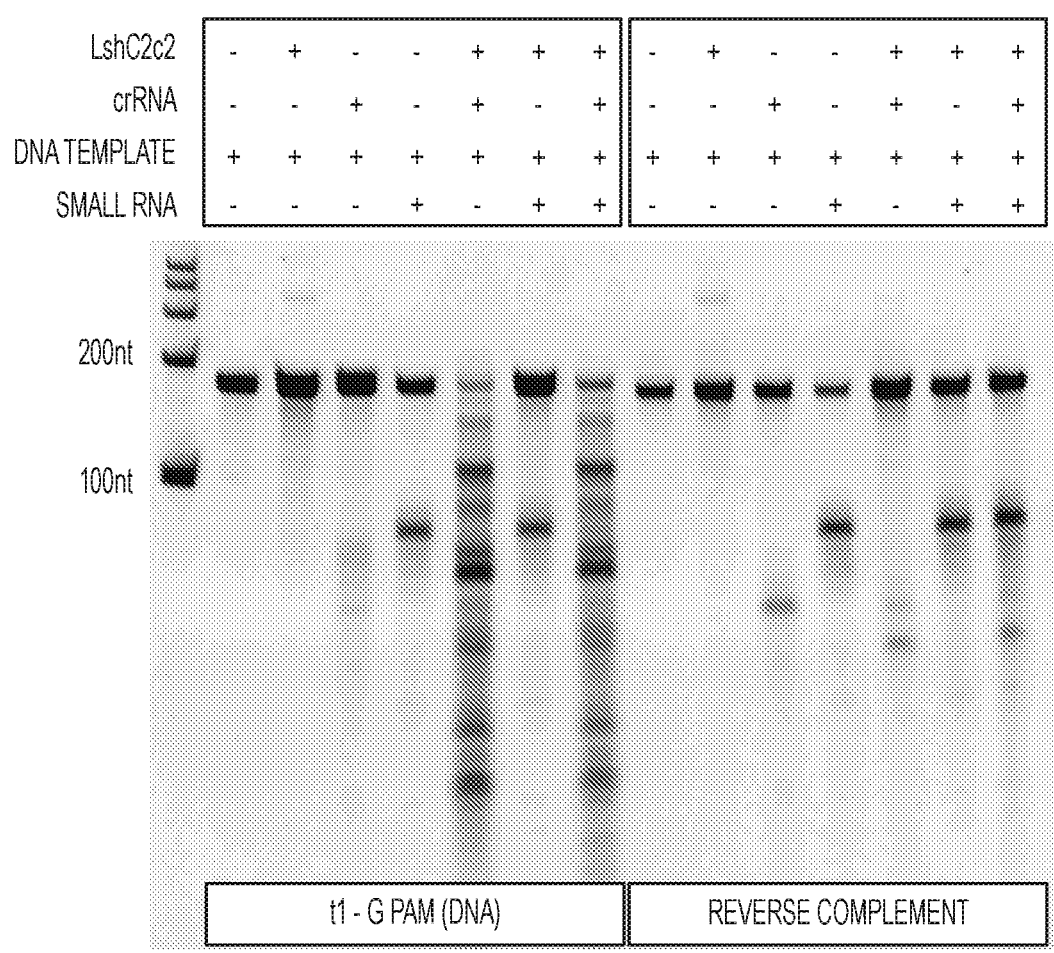
FIG. 68 depicts C2c2-mediated cleavage directed to RNA expressed from a DNA template in vitro. Reaction components are indicated. Lanes 2-8: C2c2-mediated cleavage is targeted to T1 (see FIG. 65). Lanes 9-15: C2c2-mediated cleavage is targeted to the reverse complement of T1.
Figure 69:
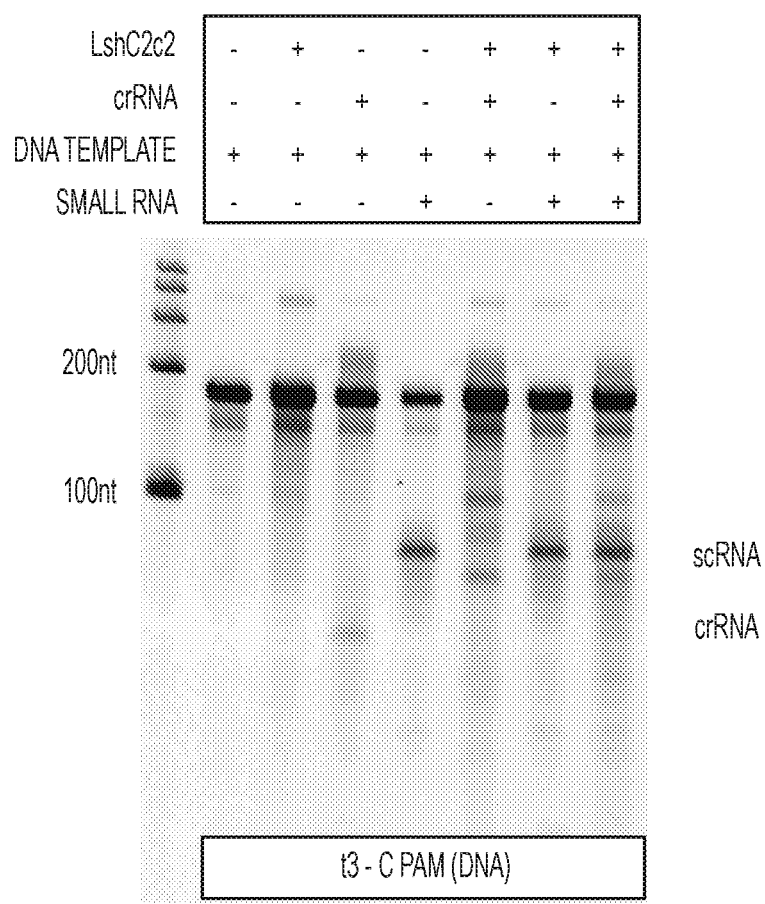
FIG. 69 depicts C2c2-mediated cleavage directed to RNA expressed from a DNA template in vitro. Reaction components are indicated. Lanes 2-8: C2c2-mediated cleavage is targeted to T3 (see FIG. 65).
Figure 70:
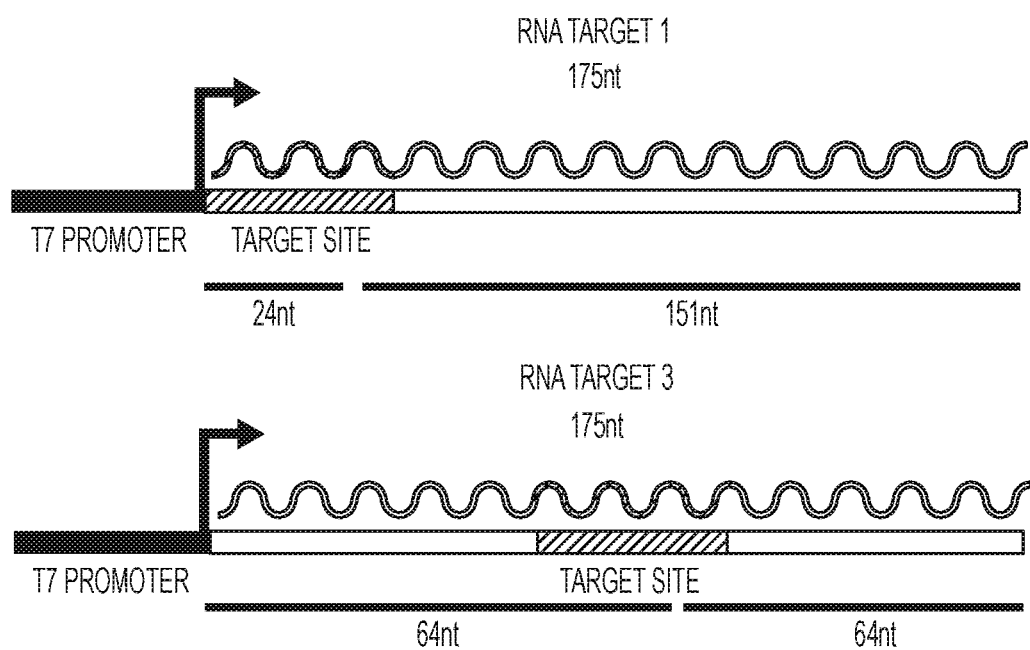
FIG. 70 depicts RNA fragment sizes observed for C2c2-mediated cleavage targeted to T1 or T3 (see FIG. 65).
Figure 87:
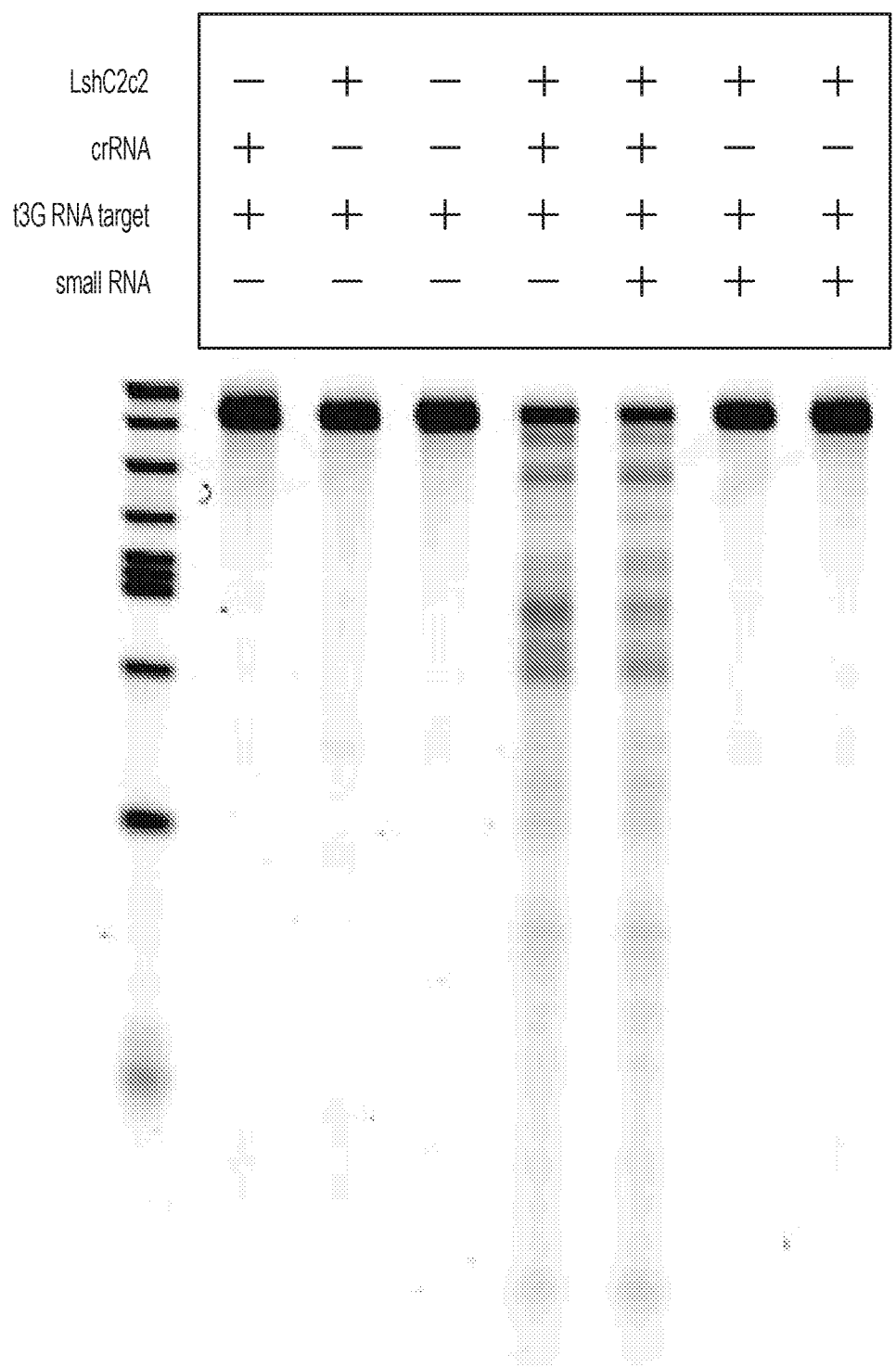
FIG. 87 demonstrates that LshC2c2 does not require the small RNA for RNA cleavage.

RNA targeting and target selection was investigated using a model transcript and testing different targets (FIG. 65). Cleavage of RNA was tested using RNA targets (FIGS. 66 and 67) and RNA transcribed from DNA templates (FIGS. 68 and 69). Observed RNA cleavage products coincided in size with those expected from the model transcript (FIG. 70). FIG. 87 demonstrates that LshC2c2 does not require the small RNA for RNA cleavage.

Example 4: C2C2 Targets and Cuts RNA In Vitro

Leptrichia Shahii C2c2 is Capable of Interference Against ssRNA MS2 Phage

C2c2 was first discovered in a computational search of conserved unknown proteins near the adaptation protein Cas2 in order to uncover novel Class 2 CRISPR systems (Shmakov et al) and is hypothesized to be the functional effector of a novel CRISPR sub-type VI group because of little homology to other known CRISPR proteins. The C2c2 proteins has two conserved HEPN domains that show strong conservation of the active residues but little homology to any other known HEPN superfamily proteins or CRISPR effectors. However, C2c2 differs from other HEPN proteins, particularly CRISPR-associated type III proteins Csx1 and Csm6, which typically dimerize prior to cleavage of RNA, because it has two HEPN domains rather than one. Many of these unique features have prompted the classification of C2c2 as a putative type VI. Given these observations and the prevalence of C2c2-family proteins across diverse bacterial species, we sought to determine whether C2c2 CRISPR-Cas loci are biologically active and can mediate interference against RNA.

To determine whether the *Leptotrichia shahii* C2c2 (LshC2c2) is a functional RNA-targeting system, we cloned the entire LshC2c2 CRISPR-Cas locus into low-copy plasmids (pLshC2c2) to allow heterologous reconstitution in *E. coli*. With currently characterized DNA- and RNA-targeting CRISPR systems, target cleavage is dependent on two factors: 1) complementarity between the crRNA spacer sequence and target site (protospacer) and 2) the presence of the appropriate proximal adjacent motif (PAM) flanking the protospacer. Because the PAM requirement is meant to discriminate self vs. non-self recognition, it is unclear whether a uniquely RNA-targeting system would require a PAM since presumably there would be no self-RNA to even target.

Figure 73:
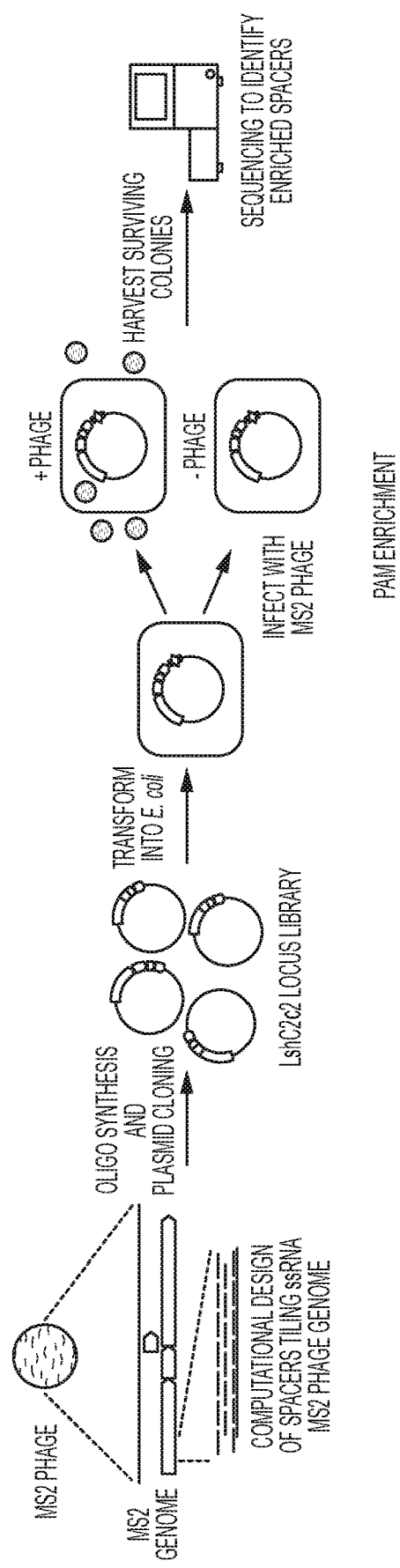
FIG. 73 shows a schematic overview of an RNA PAM screen using MS2 phage interference. A library consisting of spacers targeting all possible sequences in the MS2 RNA genome was cloned into the LshC2c2 CRISPR array. Cells with this library population were then treated with phage and plated, and surviving cells were harvested. Frequency of spacers were compared to an phage-untreated control, and phage-enriched spacers were used for generation of sequence logos.
Figure 74:
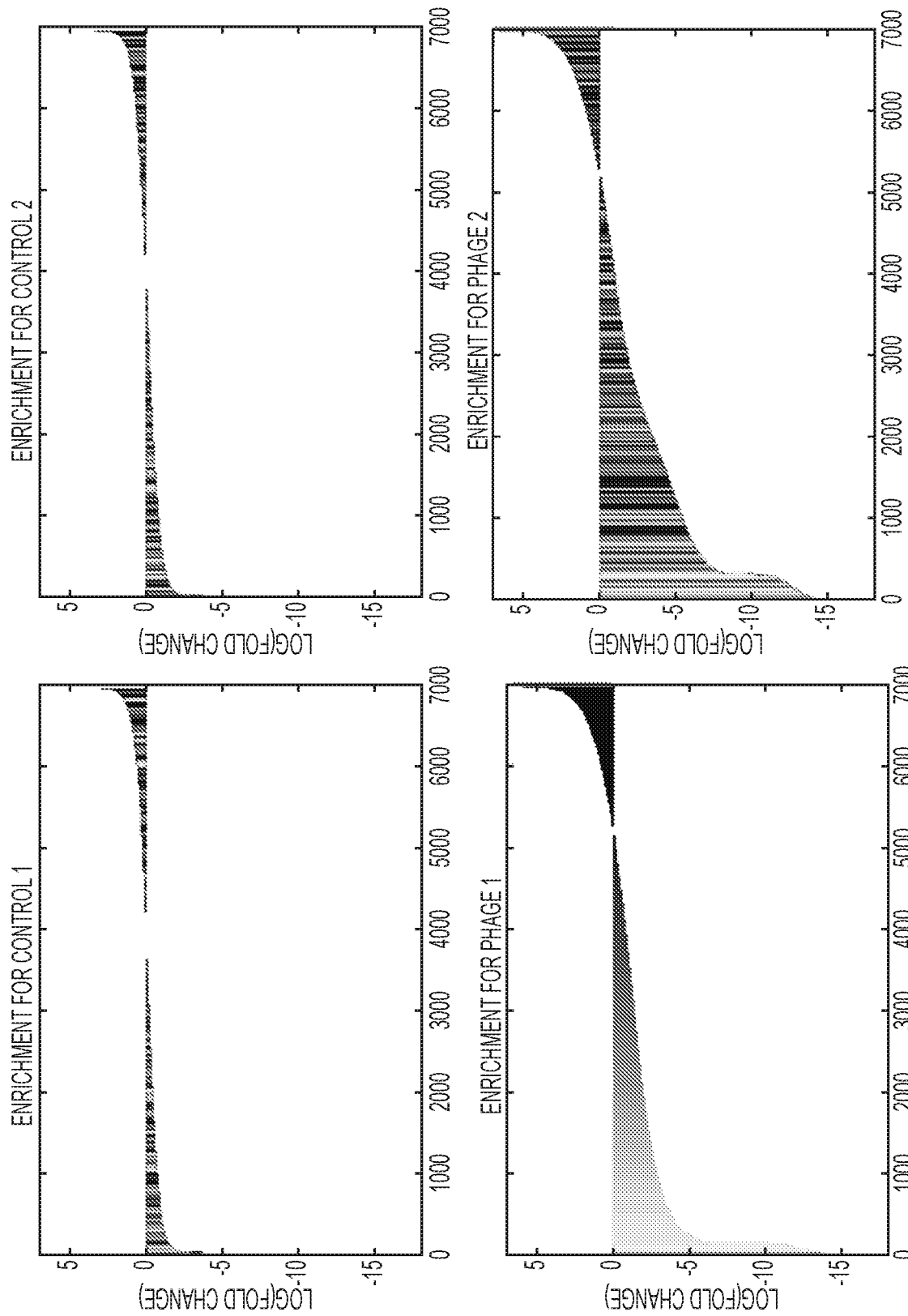
FIG. 74 indicates that RNA phage interference screen shows both strong enrichment and depletion of LshC2c2 spacers by RNA PAM screen using MS2 phage interference.
Figure 75A:
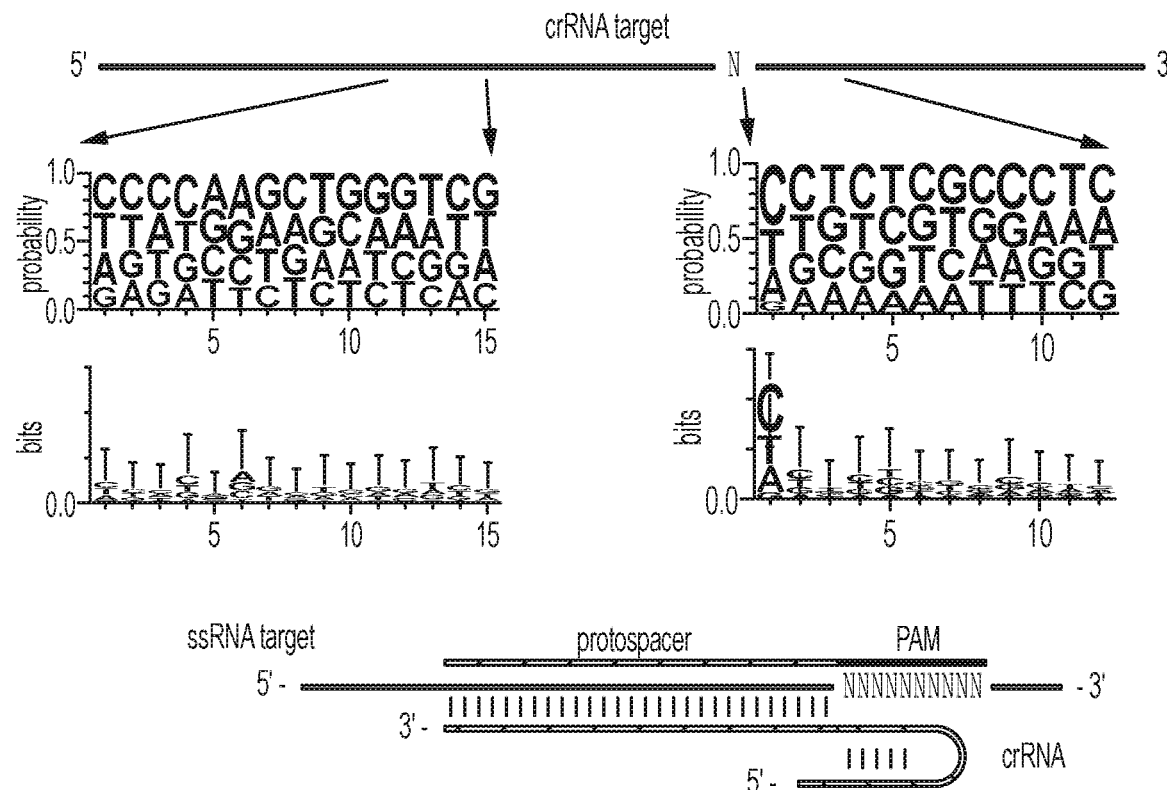
Figure 75B:
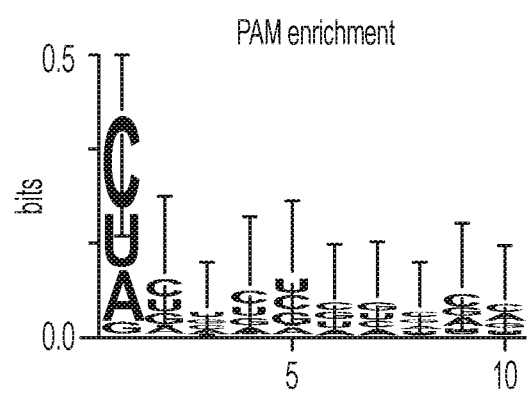
Figure 75C:
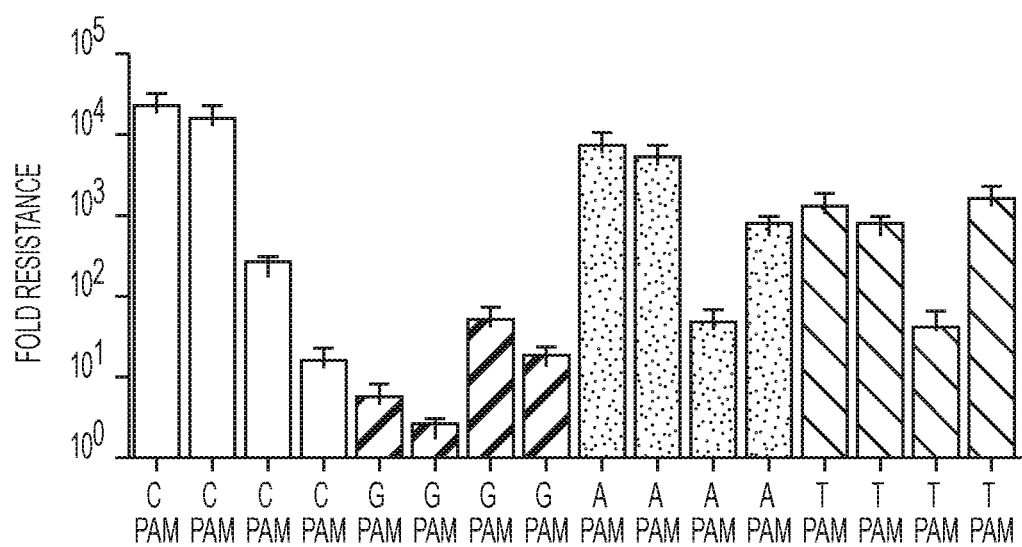
Figure 75D:
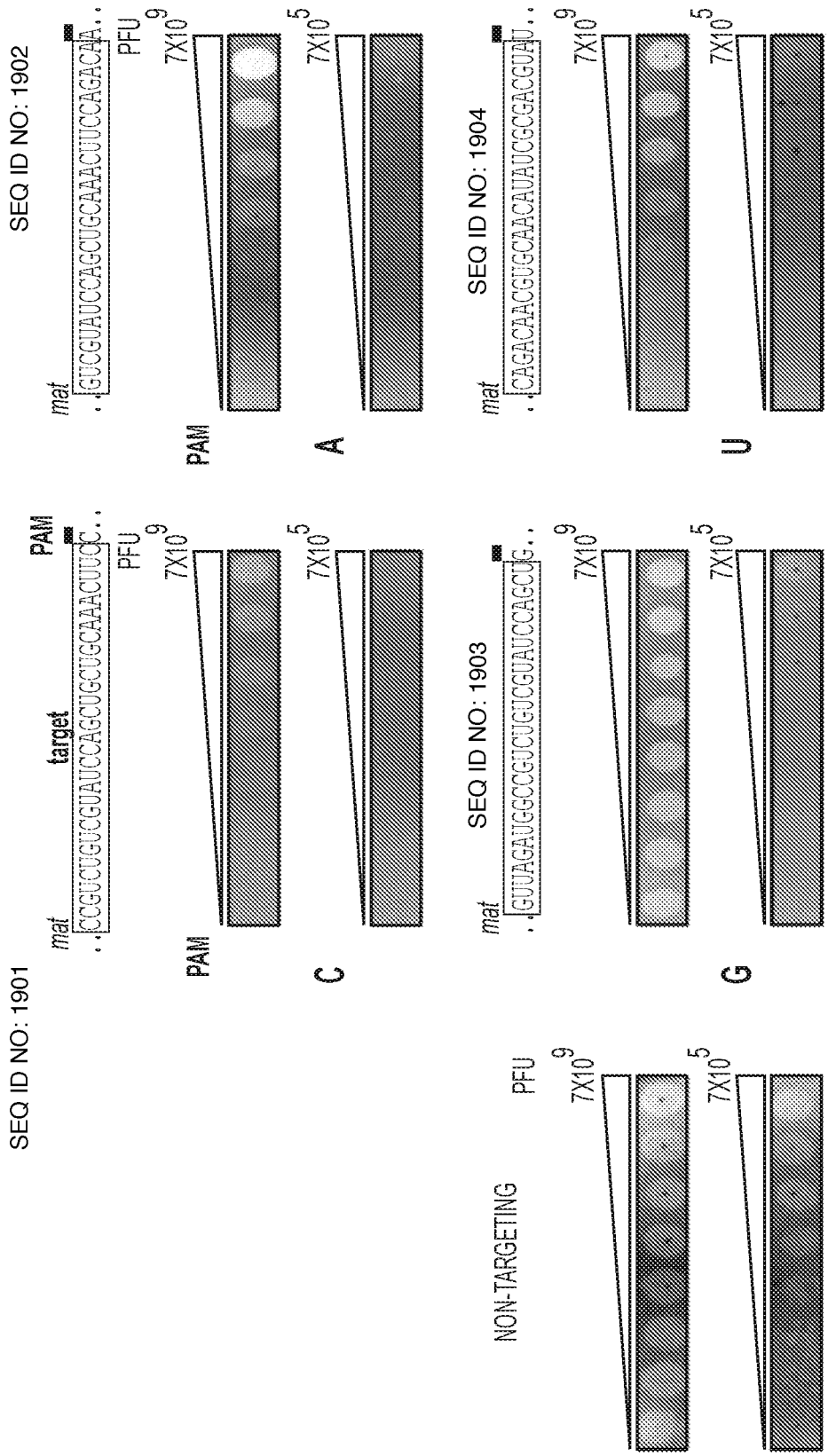
Figure 75E:
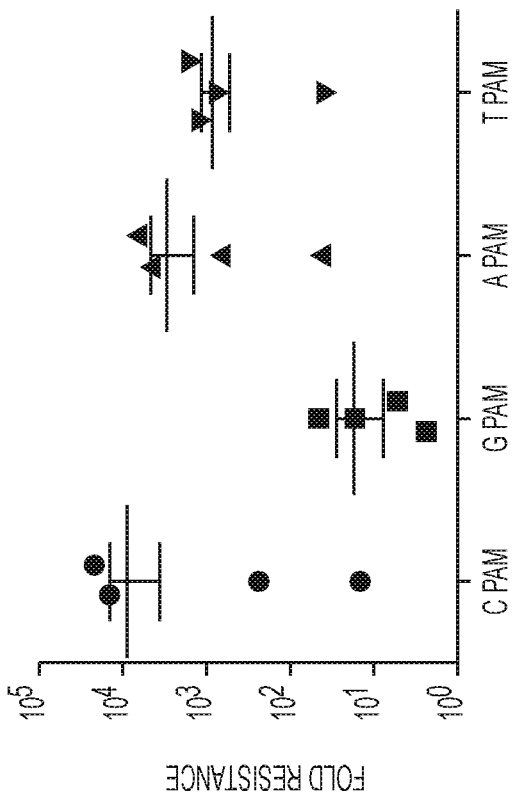
Figure 75F:
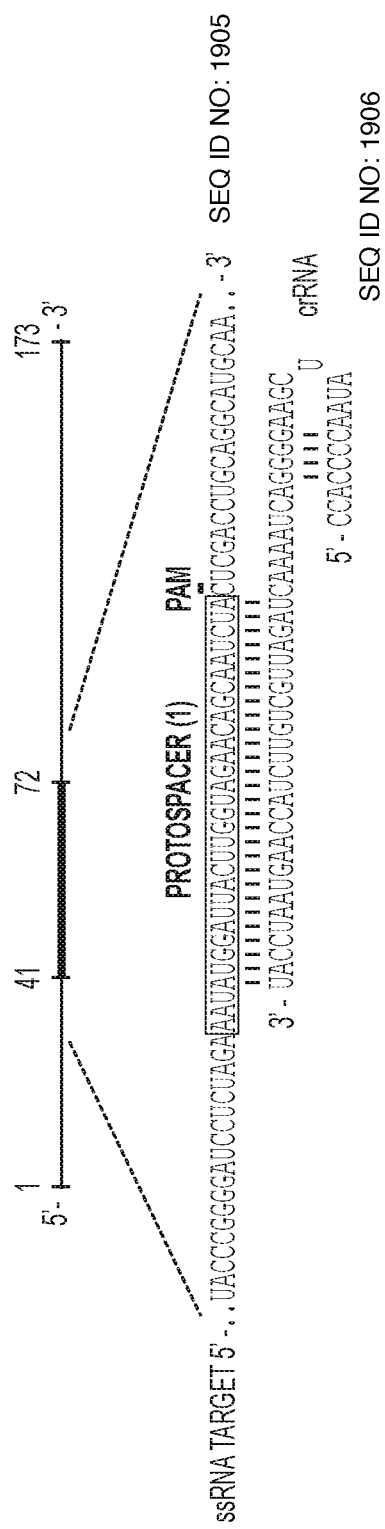
Figure 75G:
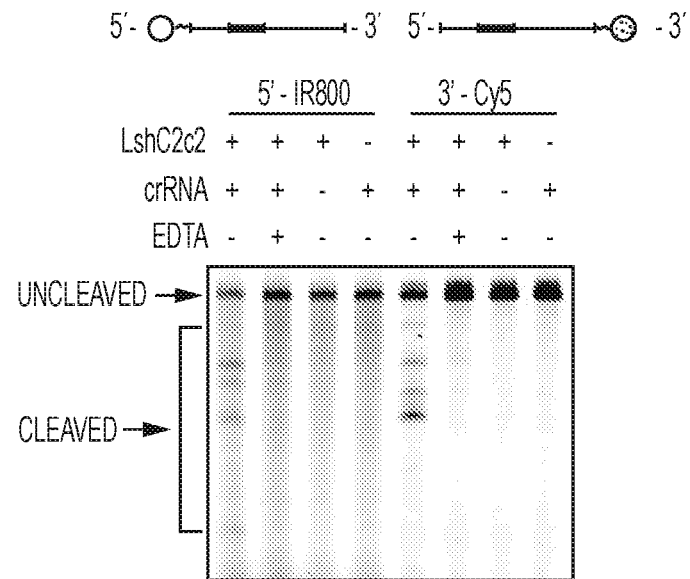
Figure 75H:
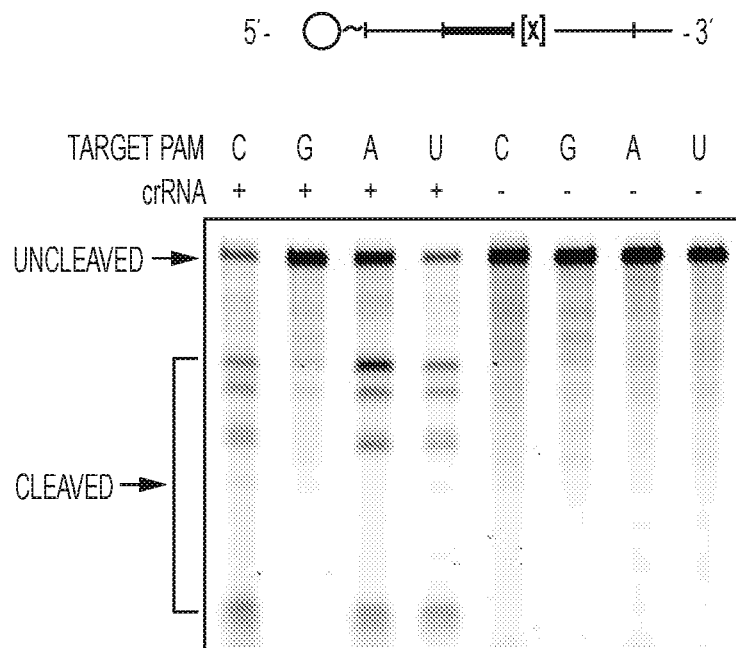
Figure 75J:
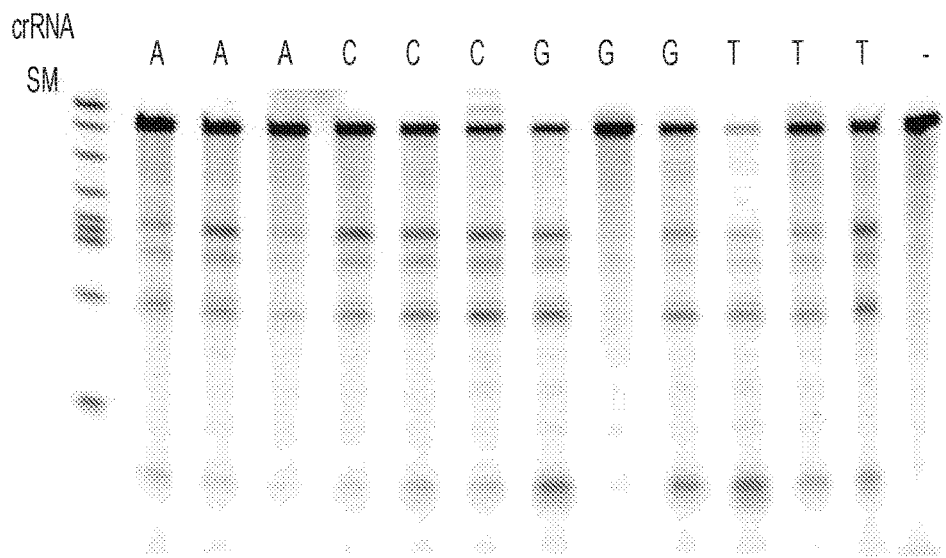
Figure 76:
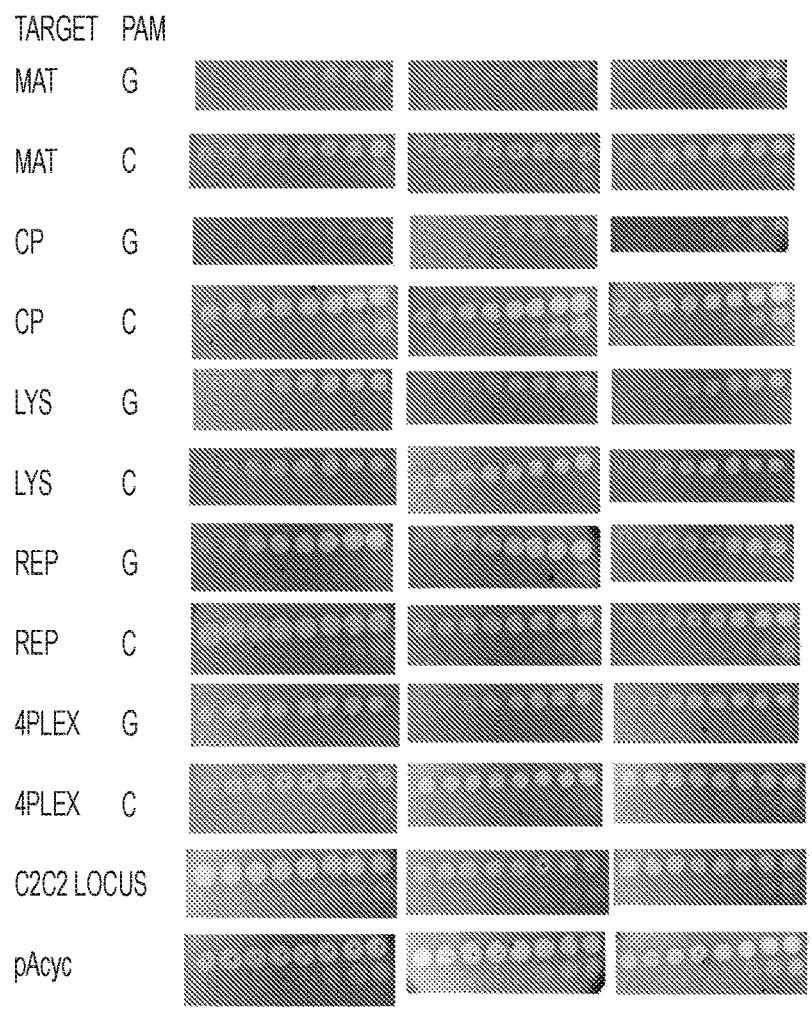
FIG. 76 shows for LshC2c2 RNA phage MS2 restriction. Cloned spacers targeting each of the four MS2 genes, with C and G PAMs. G PAMs require higher phage concentrations for plaque development.

To investigate the PAM requirements and activity of LshC2c2, we used the MS2 phage restriction assay (FIG. 73). MS2 phage is an ideal model to investigate RNA cleavage because it is a lytic single-stranded RNA phage that has no DNA intermediates during its life cycle. It readily infects *E. coli* via attachment to the F pilus and can thus be used for testing heterologous interference against ssRNA. We synthesized a library of crRNA sequences to tile every possible 28 nt target site in the MS2 phage genome in order to identify which target sites were more significantly depleted than others. The crRNA library was cloned into pLshC2c2 such that each unique spacer was the first spacer of a two-spacer array. We transformed this library into *E. coli* NovaBlue (DE3, F+) and grew the cultures with or without MS2 phage overnight. Using this assay, we were able to identify a single-nucleotide PAM by analyzing the flanking regions of the crRNA target sequences that were enriched due to resistance against MS2 infection. The analysis revealed a 3' H PAM (not G) on the RNA target indicative that there is some sequence preference by the LshC2c2 complex (FIG. 75 A-75B). Beyond the identification of a PAM, the screen revealed that the heterologously expressed LshC2c2 locus was capable of significant ssRNA interference and protection against MS2 phage infection.

To validate the screen findings, we cloned four of the top enriched spacers and showed 3- to 4-log reduction in plaquing efficiency consistent with the level of enrichment observed in the screen. Moreover, we wanted to further validate the PAM finding and so we cloned a series of four guides per possible single nucleotide PAM (16 guides in total) all targeting a region of the MS2 mat gene. We found that all 16 targets were efficiently targeted with a stronger preference for C, A, and U. Because G PAMs are still targeted and there were a minority enriched in the interference screen, the PAM may be more relaxed than a 3' H PAM.

The C2C2 protein from *Leptotrichia shahii* was expressed in *E. coli* and purified using His-tag affinity purification followed by three rounds of gel filtration on an Akta FPLC using a Superdex 200 column. For in vitro cleavage experiments, a 175 nucleotide RNA target (labeled t1 and t3 respectively, see below for sequences) was combined with a 5× molar excess of C2c2 protein and crRNA (using a 28 nucleotide spacer and a 28 nucleotide direct repeat, see below for sequence) and incubated at 37 C for 15 minutes in the buffers indicated in the figure panels. The reaction was quenched with proteinase K incubation for 15 min at 37 C and subsequently denatured in TBE-Urea loading buffer at 85C for 5 min. Samples were resolved on a denaturing TBE Urea PAGE gel.

Figure 71:
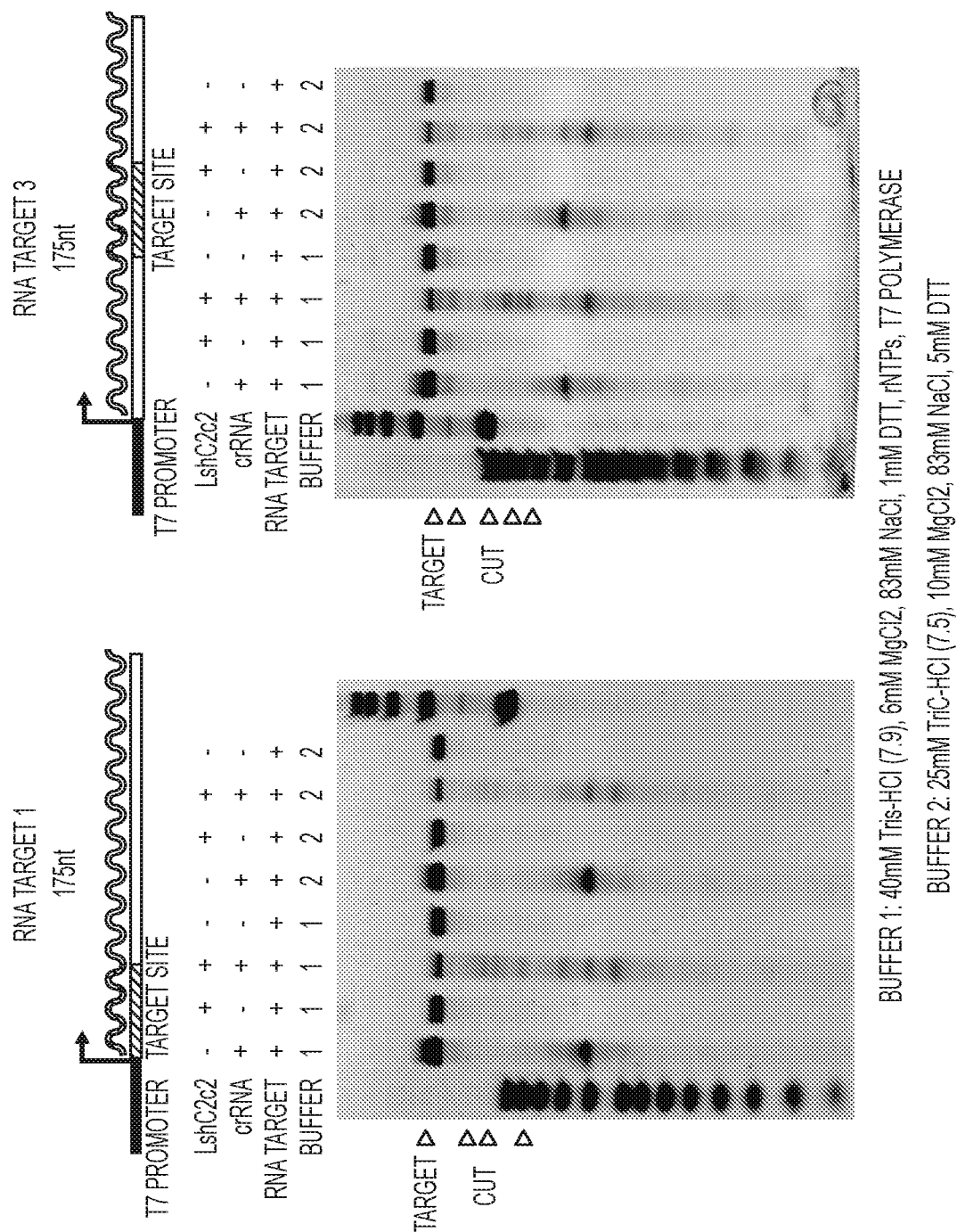
FIG. 71 depicts C2c2 mediated RNA cleavage of targets T1 and T3. There are multiple cleavage products and significant reduction in intensity of the target band. Buffer 1: 40 mM Tris-HCl (pH 7.9), 6 mM MgCL$_2$, 83 mM NaCl, 1 mM DTT, rNTPs, T7 polymerase. Buffer 2: 25 mM Tris-HCl (pH 7.5), 10 mM MgCL$_2$, 83 mM NaCl, 5 mM DTT. Buffer 2 replicates reaction conditions without DNA template.
Figure 79:
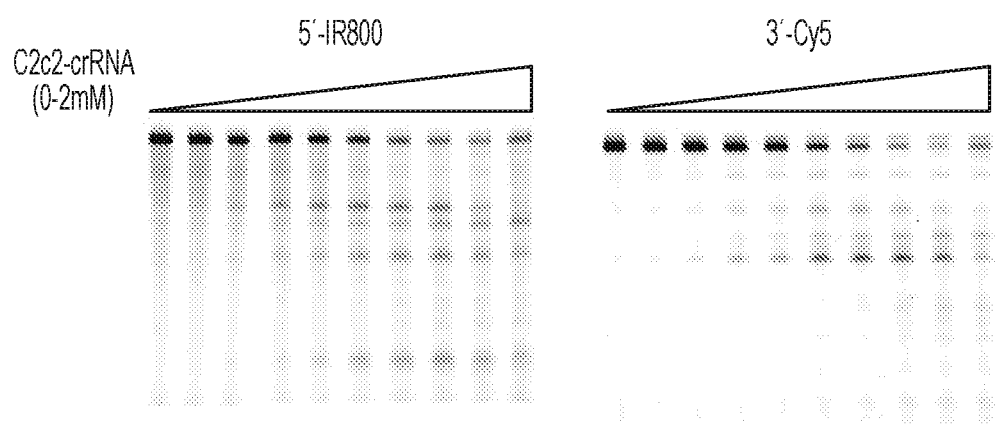
FIG. 79: LshC2c2 protein and crRNA were incubated and serially diluted. ssRNA cleavage was assayed using the indicated complex concentrations.
Figure 80:
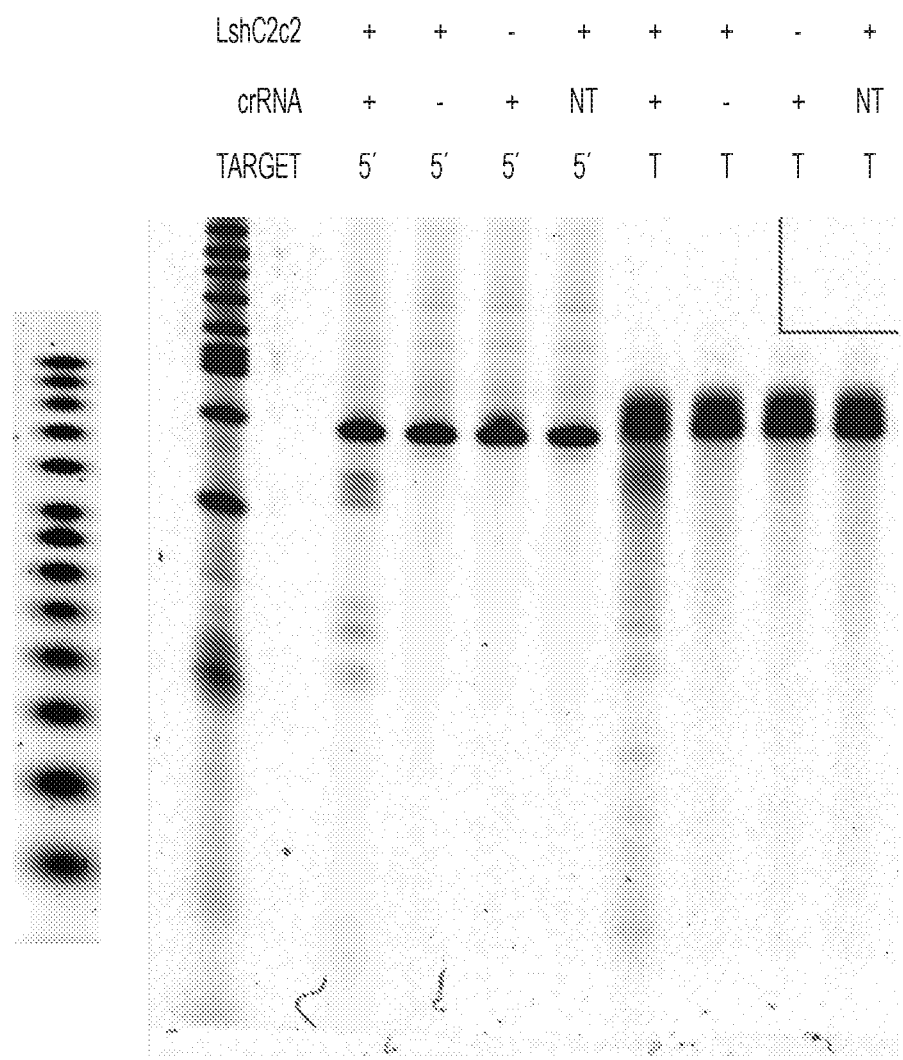
FIG. 80 demonstrates that LshC2c2 efficiently cleaves RNA. 20 cm gel readout; 700 nm fluorescent imaging. Cleavage is observed just with a smaller 85 nt RNA target instead of the usual 173 nt target.
Figure 81:
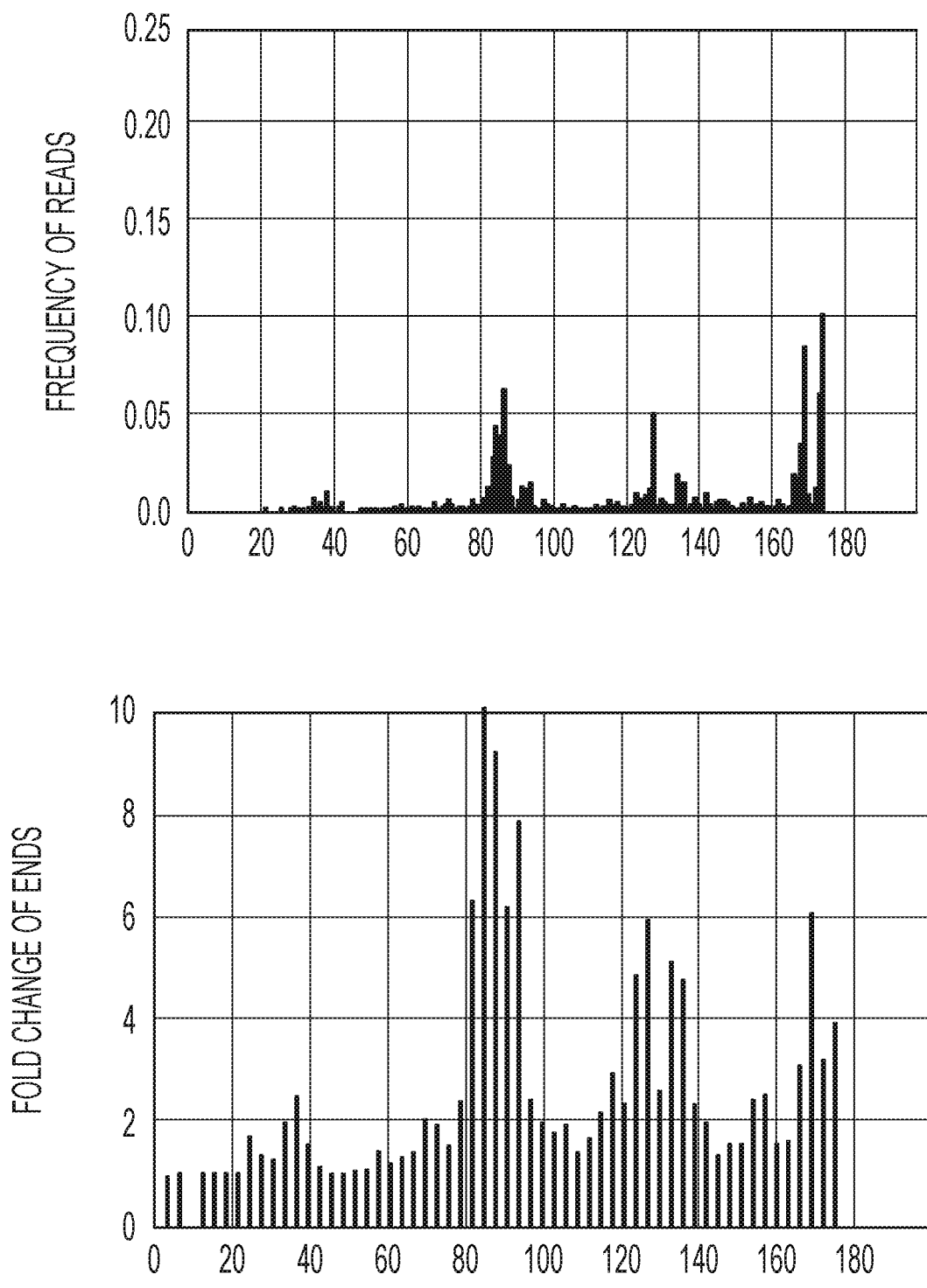
FIG. 81 shows mapping of cleavage fragments.

The results indicate that C2C2 mediates efficient degradation of the RNA target in a crRNA-dependent manner. (FIG. 71, FIG. 79, FIG. 80) Notably, the crRNA itself is also cleaved during this process.

Figure 77:
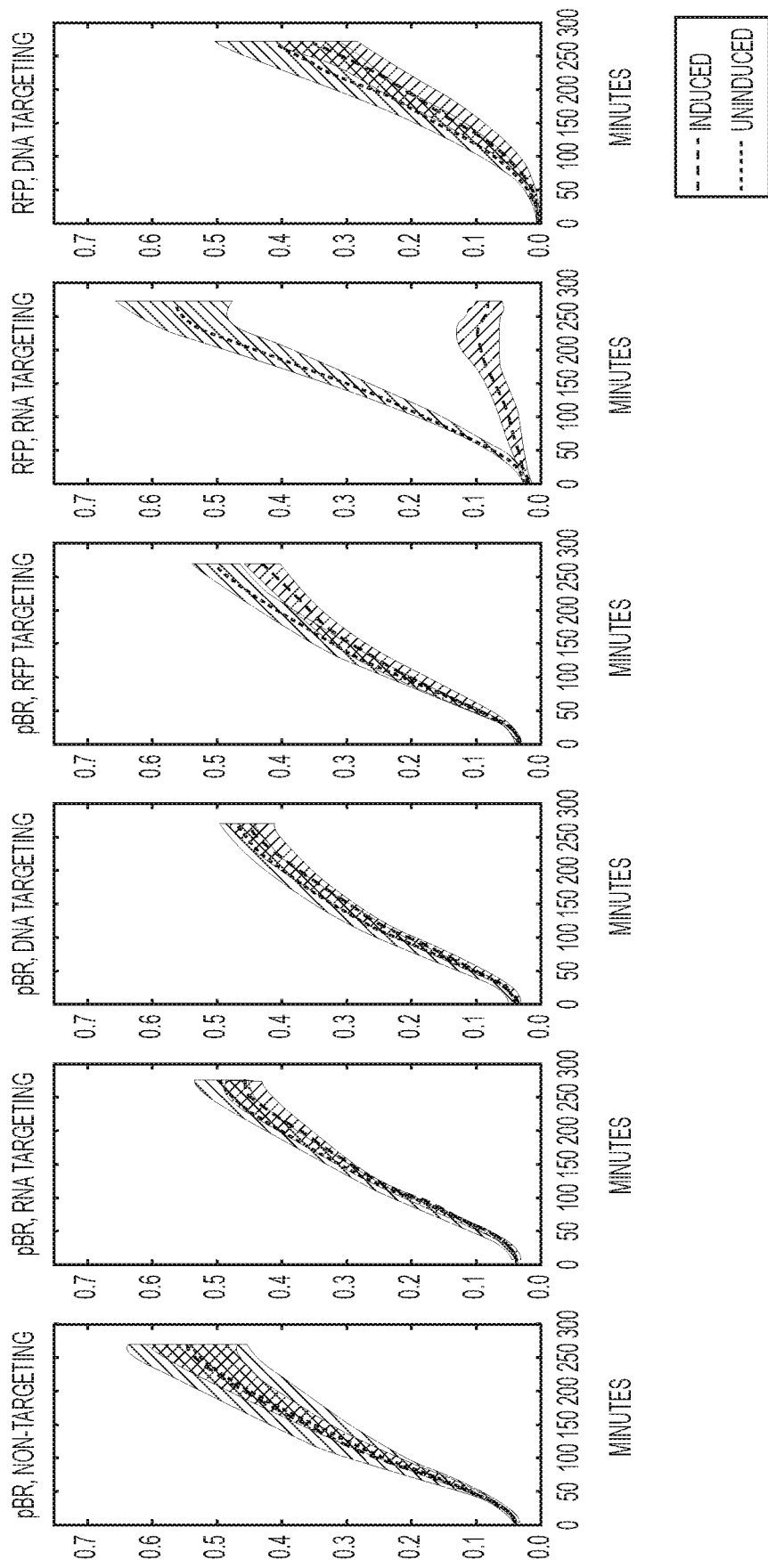
FIG. 77 shows that targeting of RFP transcripts in bacteria slows growth rate.
Figure 78A:
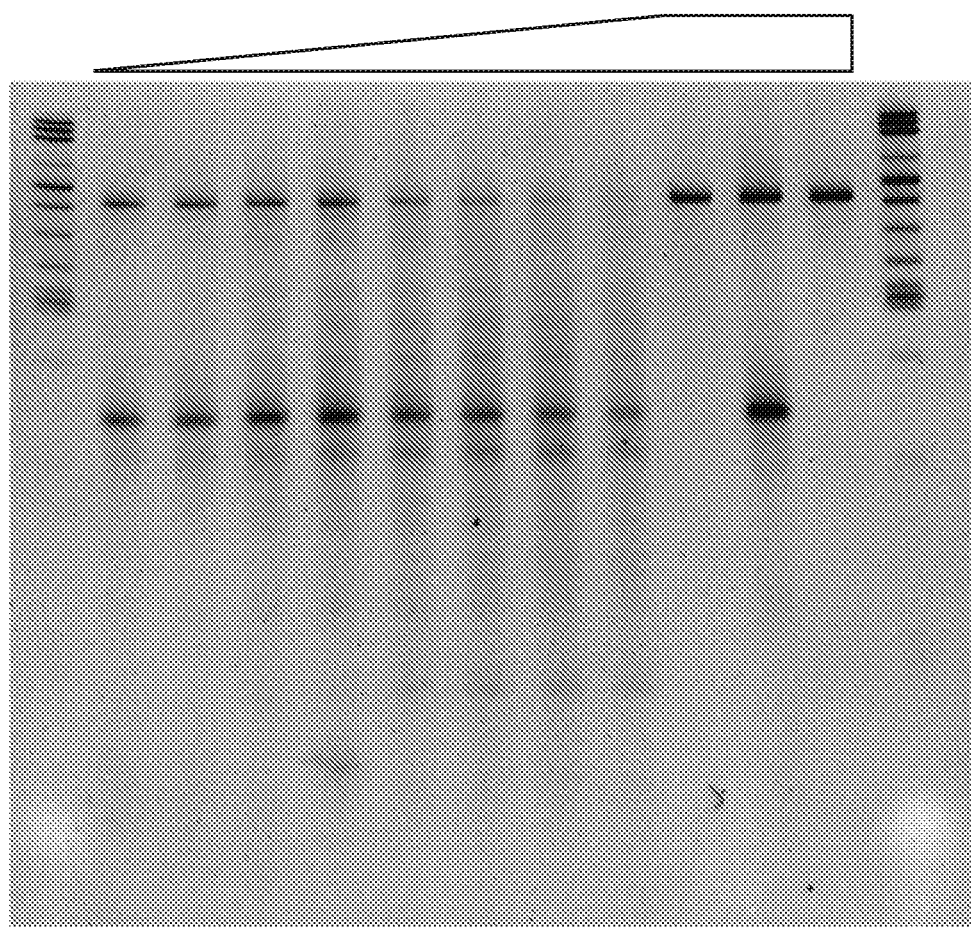
FIG. 78A-78D.
Figure 78B:
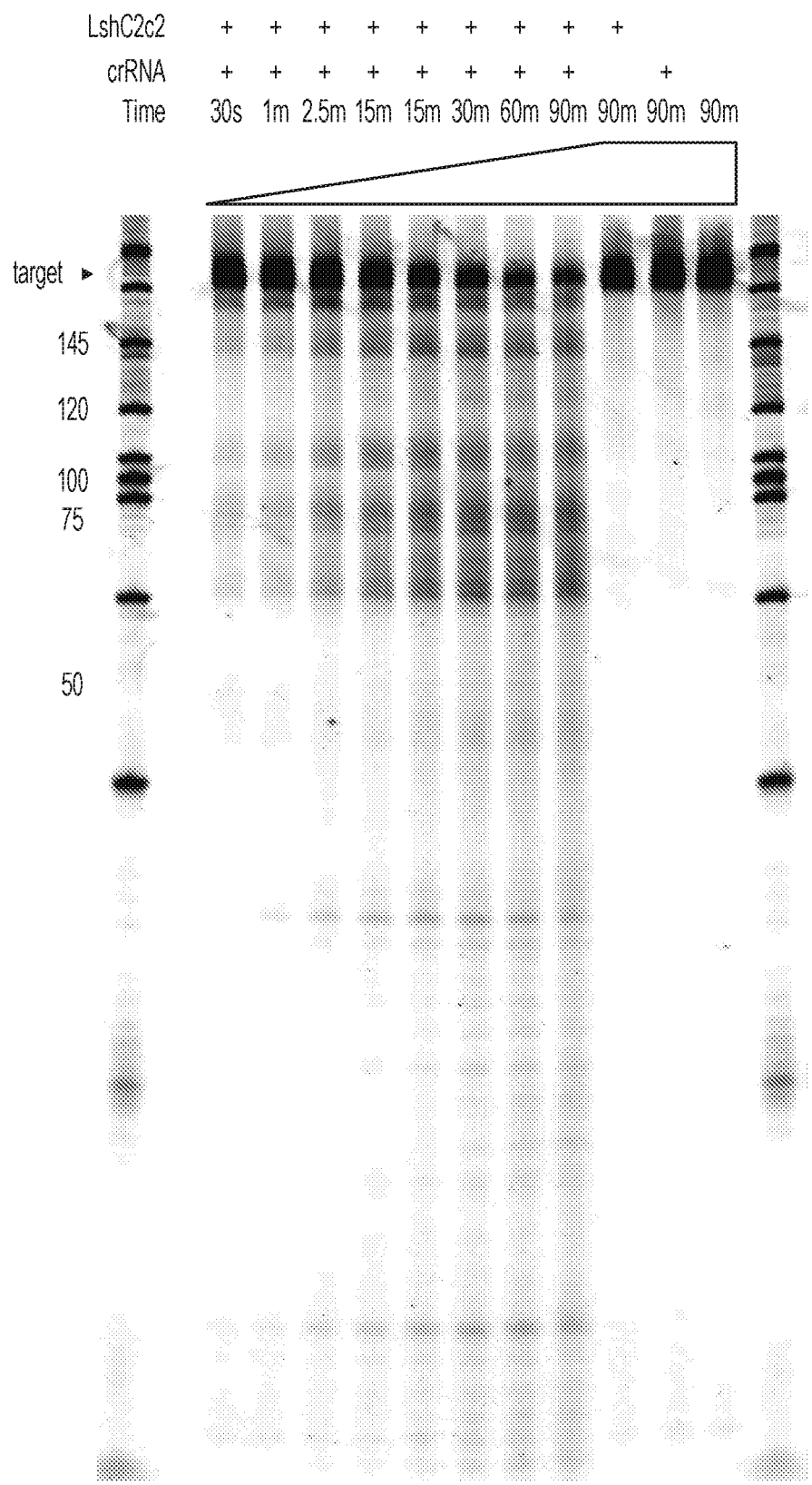
Figure 78C:
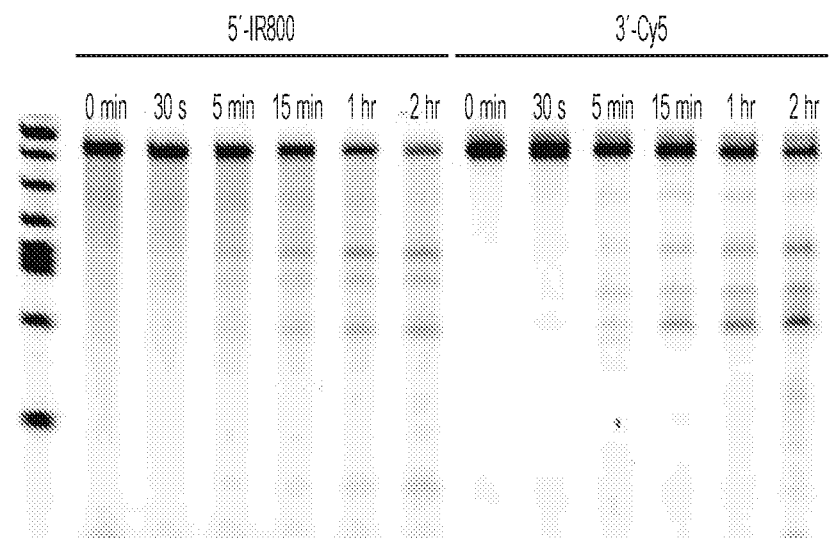
Figure 78D:
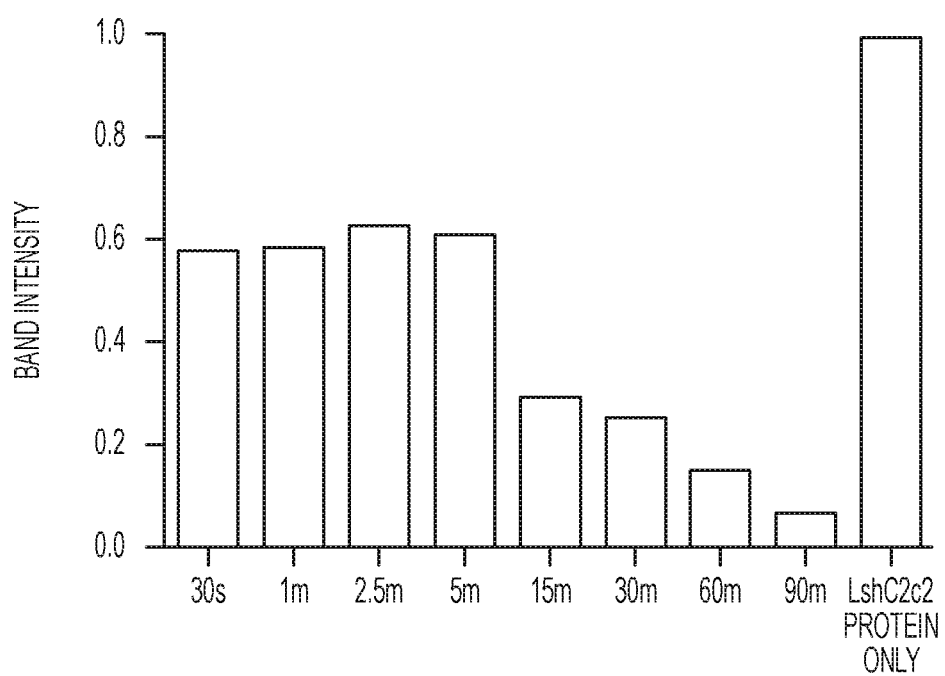

Targeting of RFT transcripts in bacteria showed that growth rate is reduced (FIG. 77). Without wishing to be bound by theory, this may suggest that the HEPN system is a suicidal phage defense system.

Cleavage fragments were mapped as indicated in FIGS. 81 and 114A-114B-2.

RNA-sequencing of IVC (in vitro cleavage) was performed as indicated in FIG. 82.

RNA target 1 Sequence

```
                                       (SEQ ID NO: 68)
aatatggattacttggtagaacagcaatctaCGCCAGAAATTCGAGCTCG

GTACCCGGGGATCCTCTAGAGTCGACCTGCAGGCATGCAAGCTTGGCGTA

ATCATGGTCATAGCTGTTTCCTGTGTttatccgctcacaattccacacaa catacgagccggaagcataaag
```

RNA Target 3 Sequence

```
                                       (SEQ ID NO: 69)
GGCCAGTGAATTCGAGCTCGGTACCCGGGGATCCTCTAGAaatatggatt acttggtagaacagcaatctaCTCGACCTGCAGGCATGCAAGCTTGGCGT AATCATGGTCATAGCTGTTTCCTGTGTttatccgctcacaattccacaca acatacgagccggaagcataaag
``` crRNA Sequence

```
                                       (SEQ ID NO: 70)
CCACCCCAATATCGAAGGGGACTAAAACtagattgagttcaccaagtaa
tccat
```

CCACCCCAATATCGAAGGGGACTAAAACtagattgctgttctaccaagtaatccat (SEQ ID NO: 70)

L. shahii C2c2 Protein Sequence

```
                                       (SEQ ID NO: 71)
MGNLFGHKRWYEVRDKKDFIKRKVKVKRNYDGNKYILNIENNNKEKID

NNKFIRKYINYKKNDNILKEFTRKFHAGNILFKLKGKEGIIRIENNDDFL

ETEEVVLYIEAYGKSEKLKALGITKKIIDEAIRQGITKDDKKIEIKRQEN

EEEIEIDIRDEYTNKTLNDCSIILRIIENDELETKKSIYEIFKNINMSLY

KIIEKIIENETEKVFENRYYEEHLREKLLKDDKIDVILTNFMEIREKIKS

NLEILGFVKFYLNVGGDKKKSKNKKMLVEKILNINVDLTVEDIADFVIKE

LEFWNITKRIEKVKKVNNEFLEKRRNRTYIKSYVLLDKHEKFKIERENKK

DVIVKFFVENIKNNSIKEKIEKILAEFKIDELIKKLEKELKKGNCDTEIF

GIFKKHYKVNFDSKKFSKKSDEEKELYKIIYRYLKGRIEKILVNEQKVRL

KKMEKIEIEKILNESILSEKILKRVKQYTLEHIMYLGKLRHNDIDMTTVN

TDDFSRLHAKEELDLELITFFASTNMELNKIFSRENINNDENIDFFGGDR

EKNYYLDKKILNSKIKIIRDLDFIDNKNNITNNFIRKFTKIGTNERNRIL

HAISKERDLQGTQDDYNKVINIIQNLKISDEEVSKALNLDVVFKDKKNII

TKINDIKISEENNNKIKYLPSFSKVLPEILNLYRNNPKNEPFDTIETEKI

VLNALIYVNKELYKKLILEDDLEENESKNIFLQELKKTLGNIDEIDENII

ENYYKNAQISASKGNNKAIKKYQKKVIECYIGYLRKNYEELFDFSDFKMN

IQEIKKQIKDINDNKTYERITVKTSDKTIVINDDFEYIISIFALLNSNAV

INKIRNRFFATSVWLNTSEYQNIIDILDEIMQLNTLRNECITENWNLNLE

EFIQKMKEIEKDFDDFKIQTKKEIFNNYYEDIKNNILTEFKDDINGCDVL

EKKLEKIVIFDDETKFEIDKKSNKILQDEQRKLSNINKKDLKKKVDQYIK

DKDQEIKSKILCRIIFNSDFLKKYKKEIDNLIEDMESENENKFQEIYYPK

ERKNELYIYKKNLFLNIGNPNFDKIYGLISNDIKMADAKFLFNIDGKNIR

KNKISEIDAILKNLNKDLNGYSKEYKEKYIKKLKENDDFFAKNIQNKNYK

SFEKDYNRVWEYKKIRDLVEFNYLNKIESYLIDINWDKAIQMARFERDMH

YIVNGLRELGIIKLSGYNTGISRAYPKRNGSDGFYTTTAYYKFFDEESYK

KFEKICYGFGIDLSENSEINKPENESIRNYISHFYIVVNPFADYSIAEQI

DRVSNLLSYSTRYNNSTYASVFEVFKKDVNLKYDELKKKFKLIGNNDILE

RLMKPKKVSVLELESYNSDYIKNLIIELLTKIENTNDTLKRPAATKKAGQ

AKKKKGSYPYDVPDYAYPYDVPDYAYPYDVPDYA
```

Figure 86:
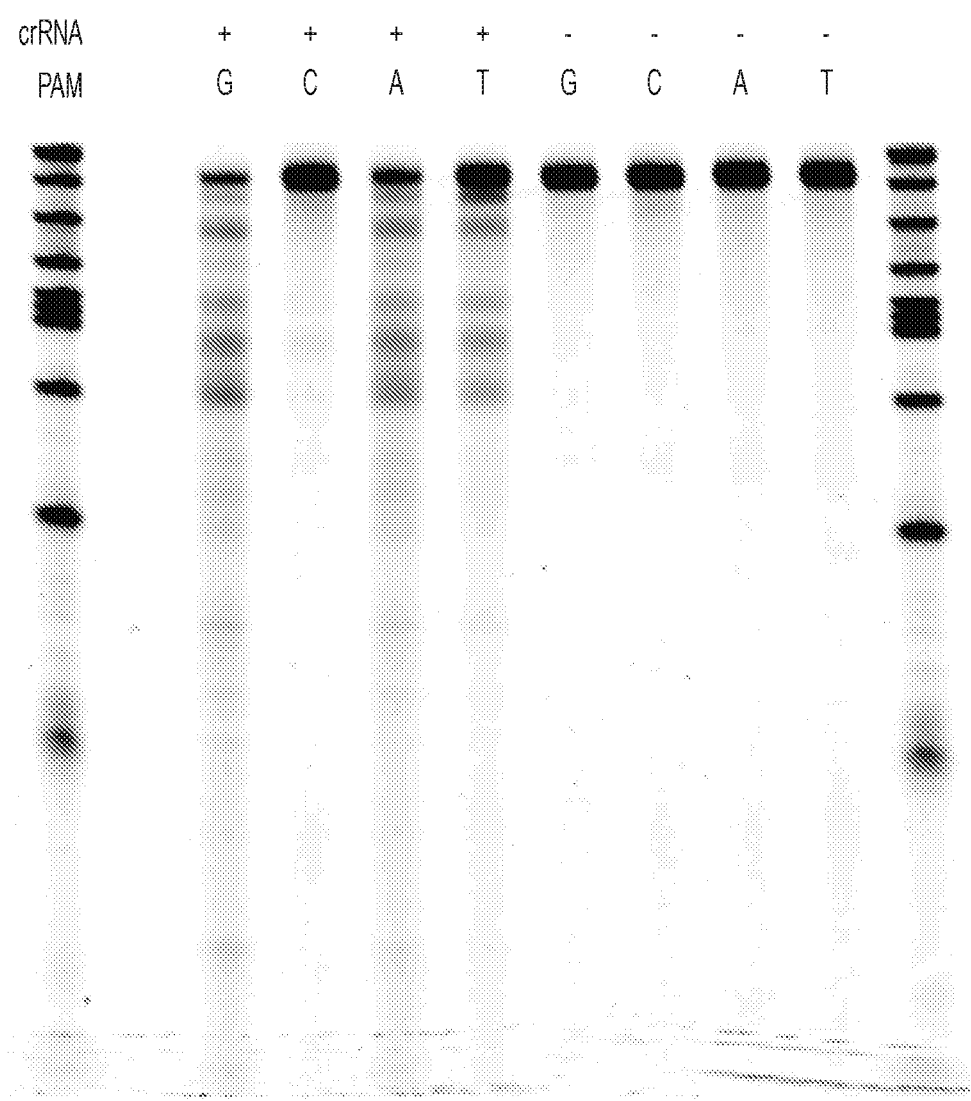
FIG. 86 demonstrates that LshC2c2 has a 3' G PAM for RNA cleavage. Same target with varying PAMs. (PAM sequence shown is on reverse complement, such that 5' C corresponds to 3'G).
Figure 88:
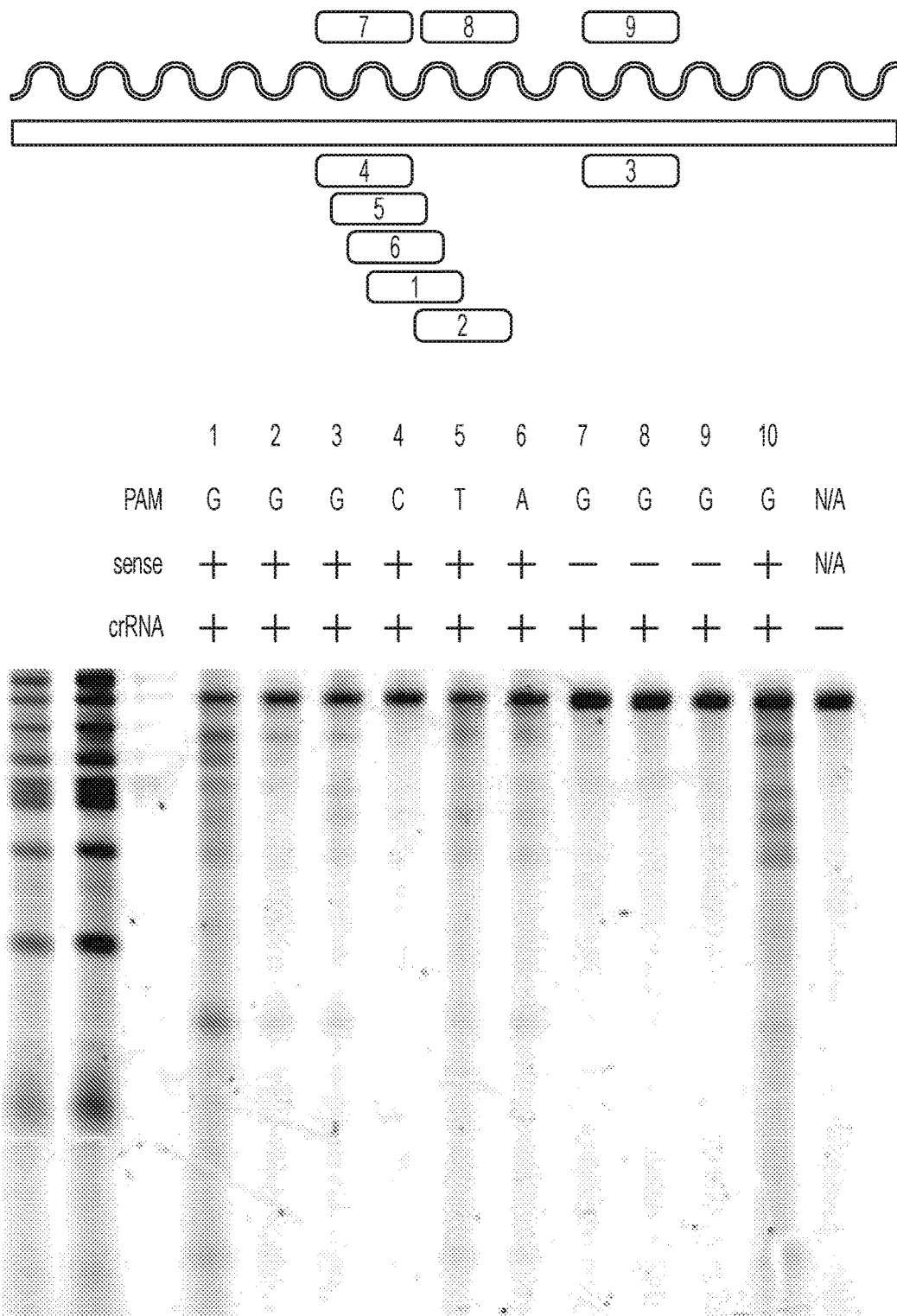
FIG. 88 demonstrates that LshC2c2 is reprogrammable and PAM sensitive.
Figure 89:
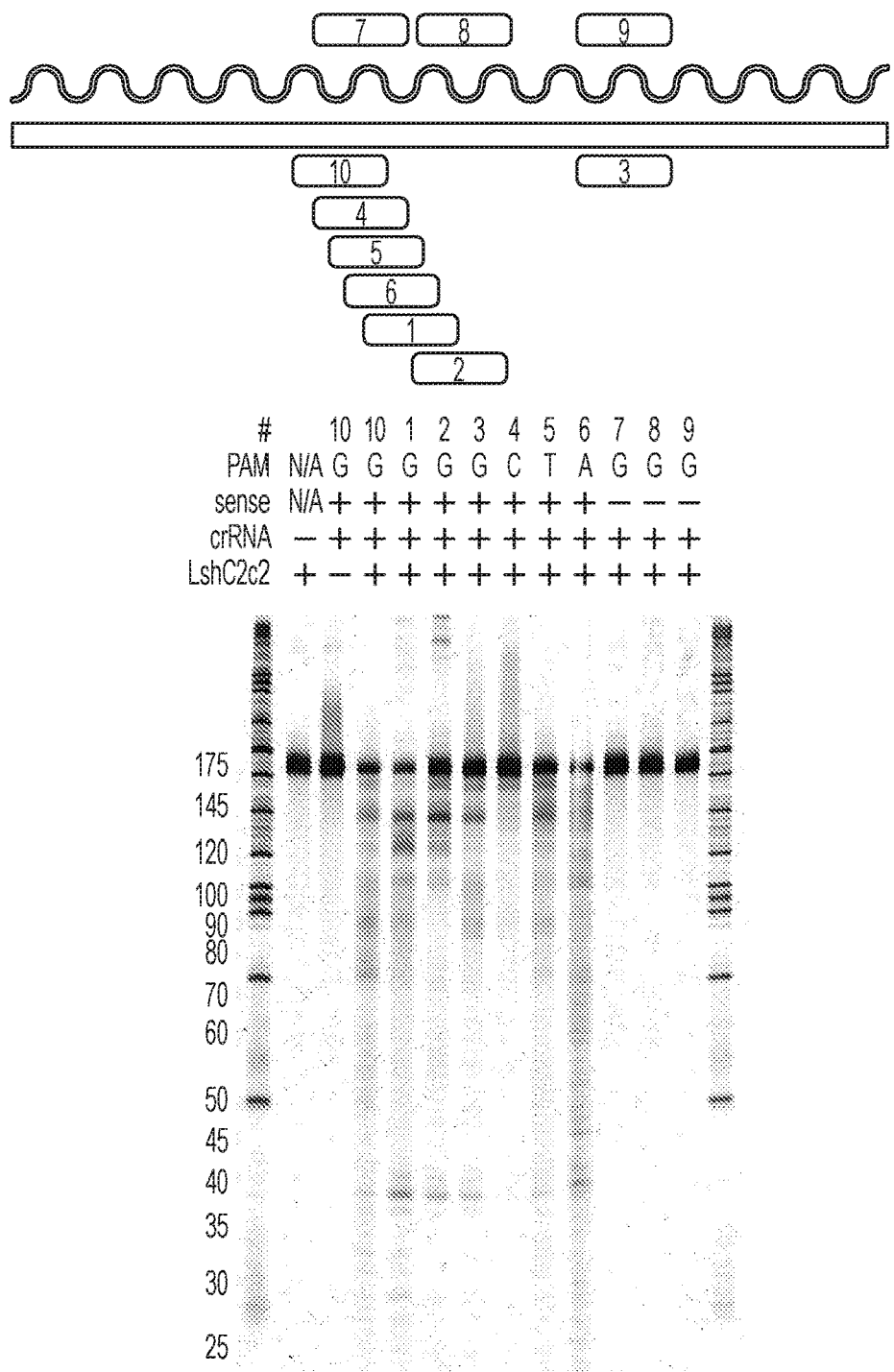
FIG. 89 demonstrates that LshC2c2 is reprogrammable and PAM sensitive.

RNA PAM screen using MS2 phage interference identified PAMs, see FIGS. 73-78D. It was determined that LshC2c2 has a 3' PAM for RNA cleavage (FIG. 86). FIGS. 88 and 89 also demonstrate that LshC2c2 is reprogrammable and PAM sensitive.

Figure 90A:
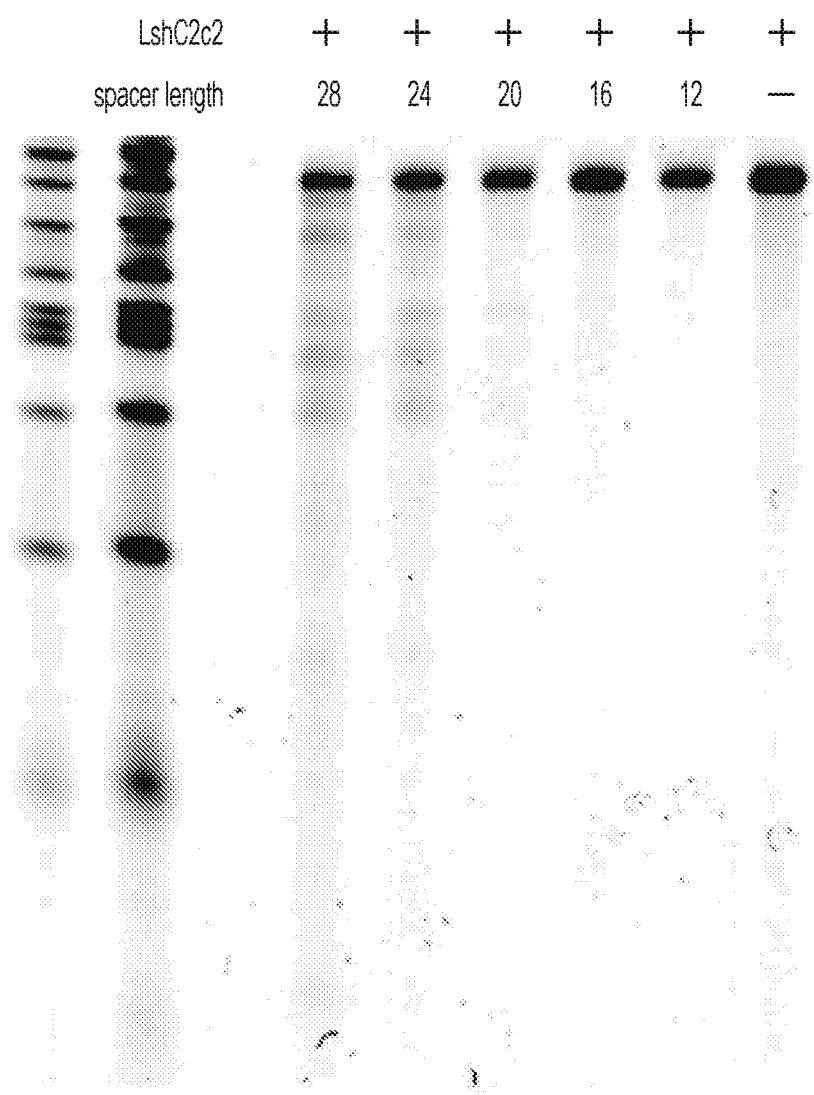
FIG. 90A-90B.
Figure 90B:
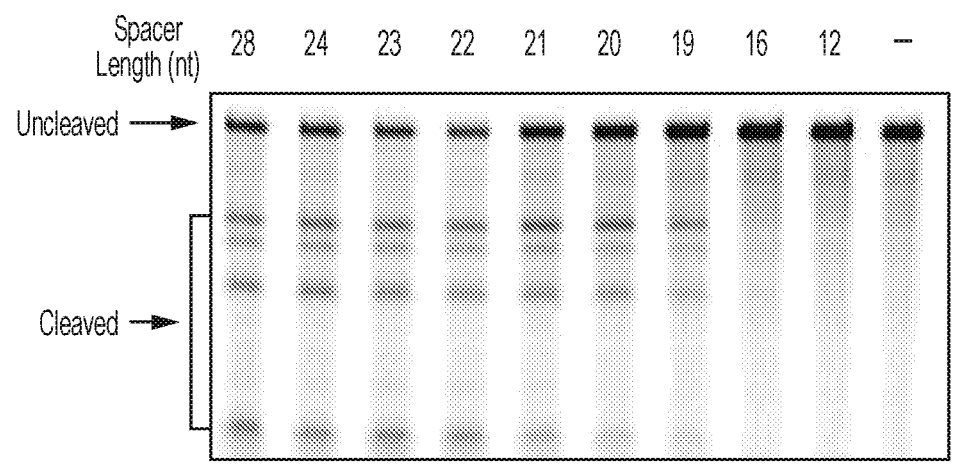
Figure 91A:
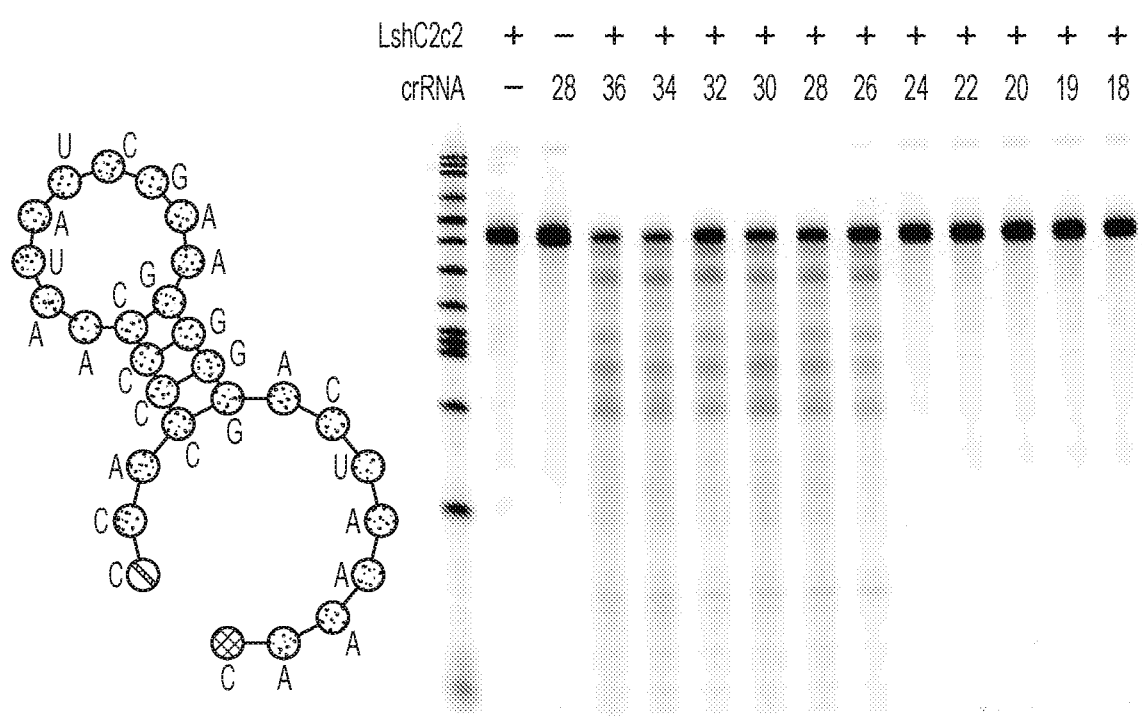
FIG. 91A-91C.
Figure 91B:
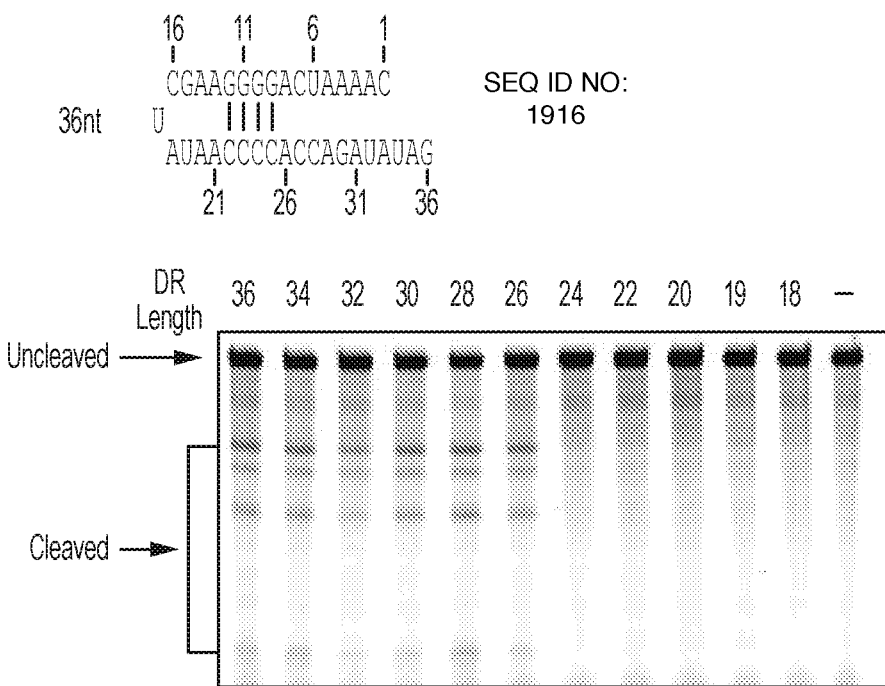
Figure 91C:
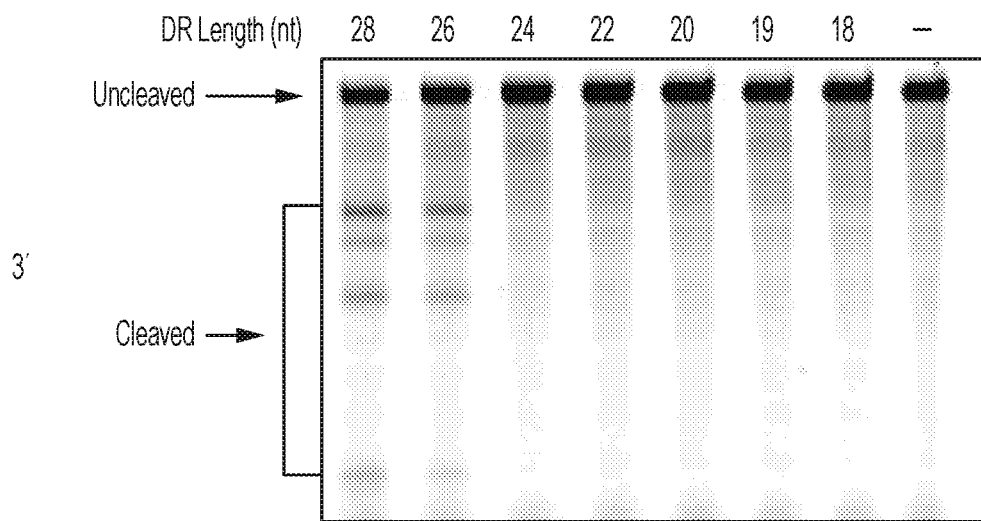
Figure 92A:
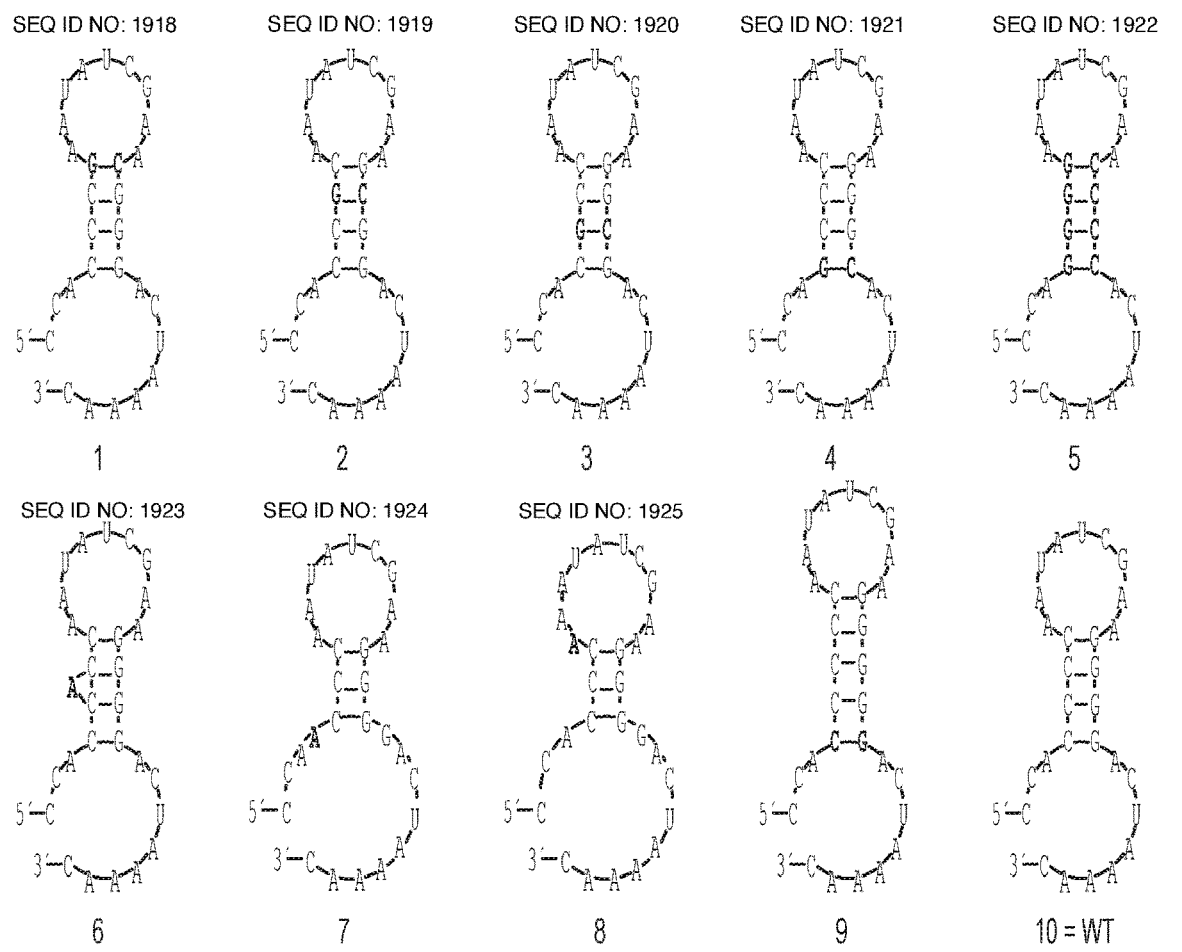
Figure 92B:
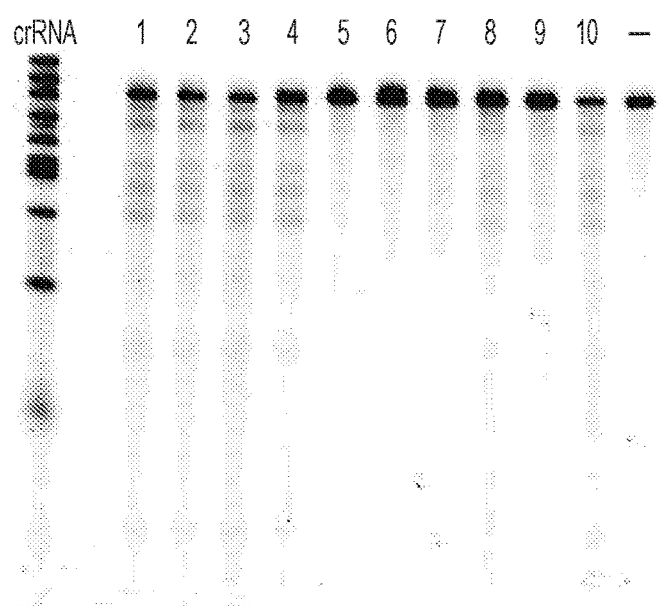
Figure 93A:
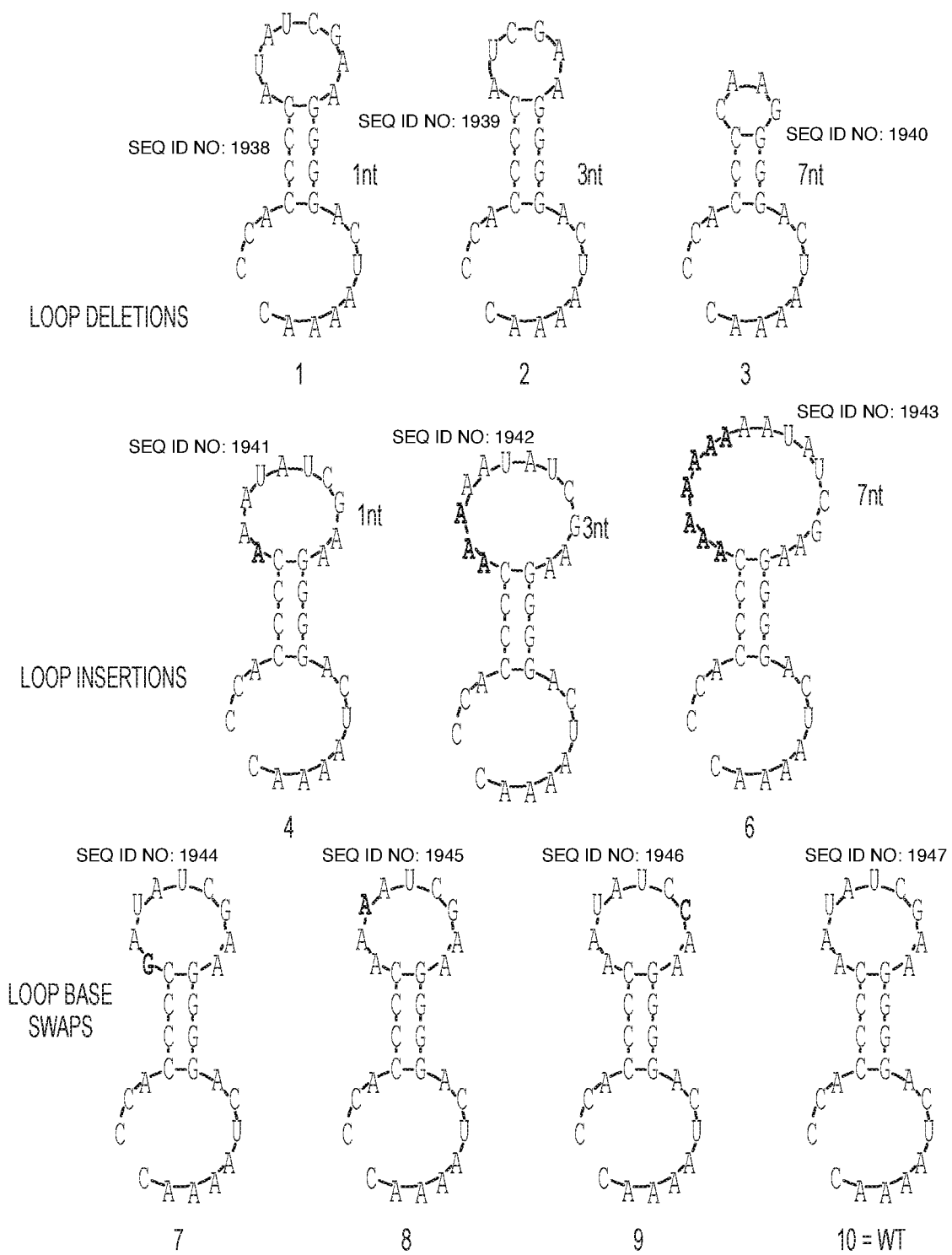
FIG. 93A-93D.
Figure 93B:
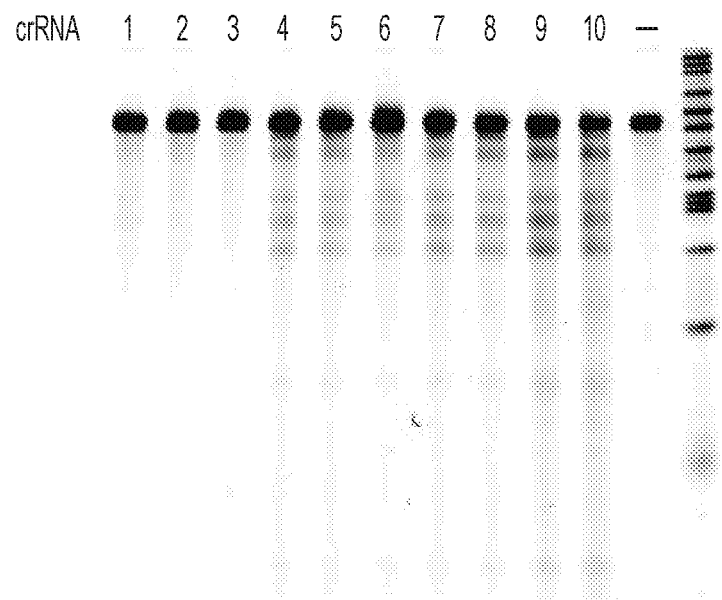
Figure 93C:
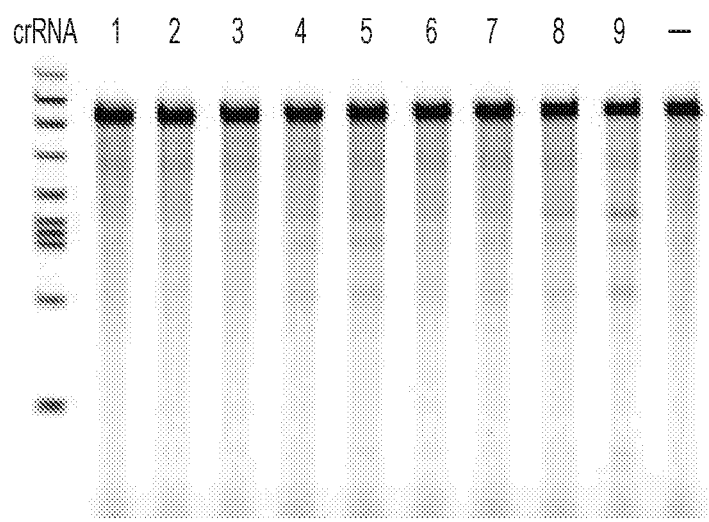
Figure 93D:
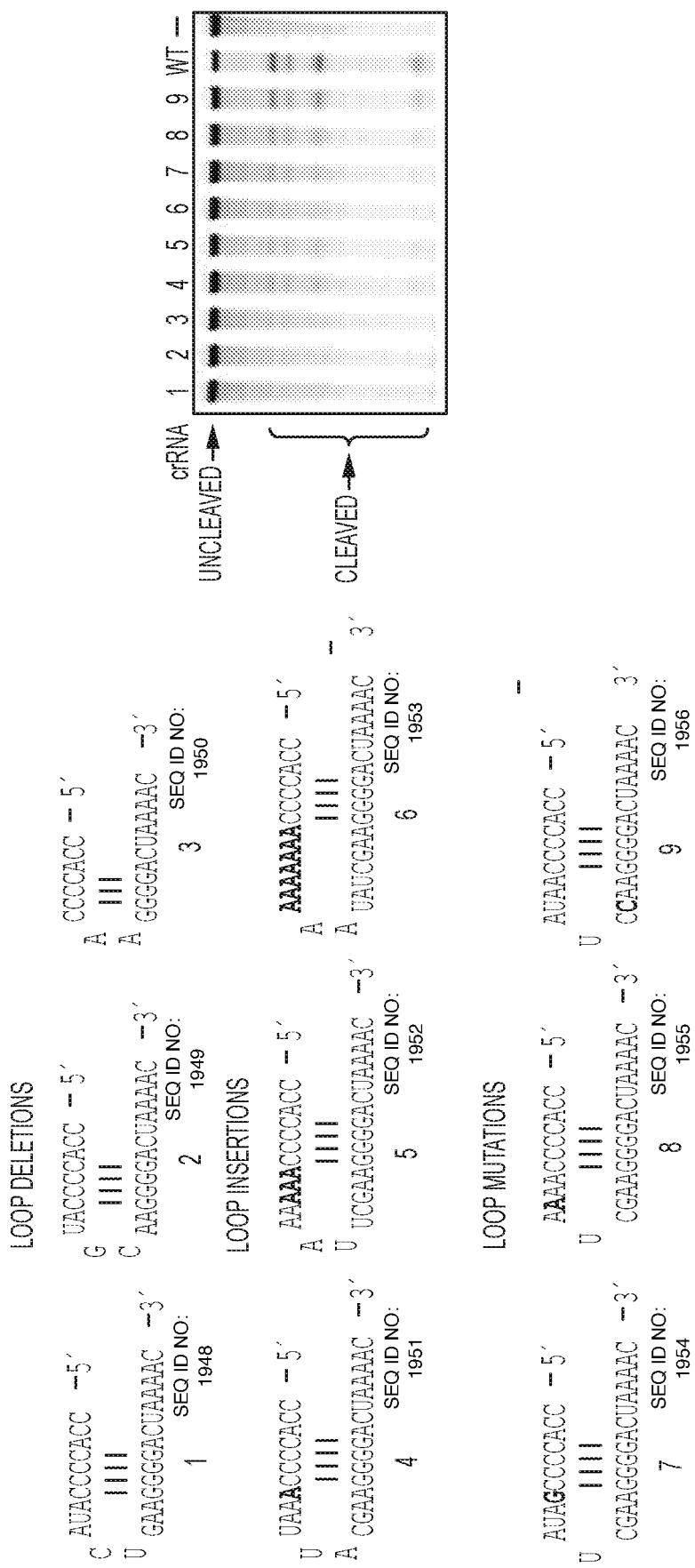

FIG. 90A-90B demonstrates that LshC2c2 cannot use spacers less than 18-22 nt.

FIGS. 91A-93D show the influence of stem loop (modifications) on cleavage. It is shown that crRNAs without stem loop do not allow for cleavage (FIG. 91A-91C) and that Stem is amenable to individual base swaps but activity is disrupted by secondary structure changes. DR Truncation experiments also indicate that disruption of the stem abolishes cleavage (FIG. 92A-92D and FIG. 93A-93D).

Figure 100A:
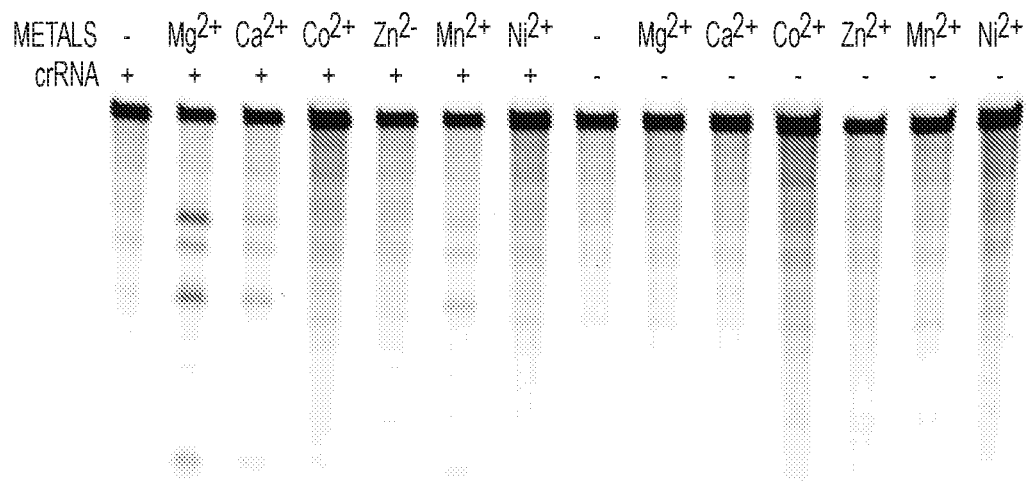
FIG. 100A-100B.
Figure 100B:
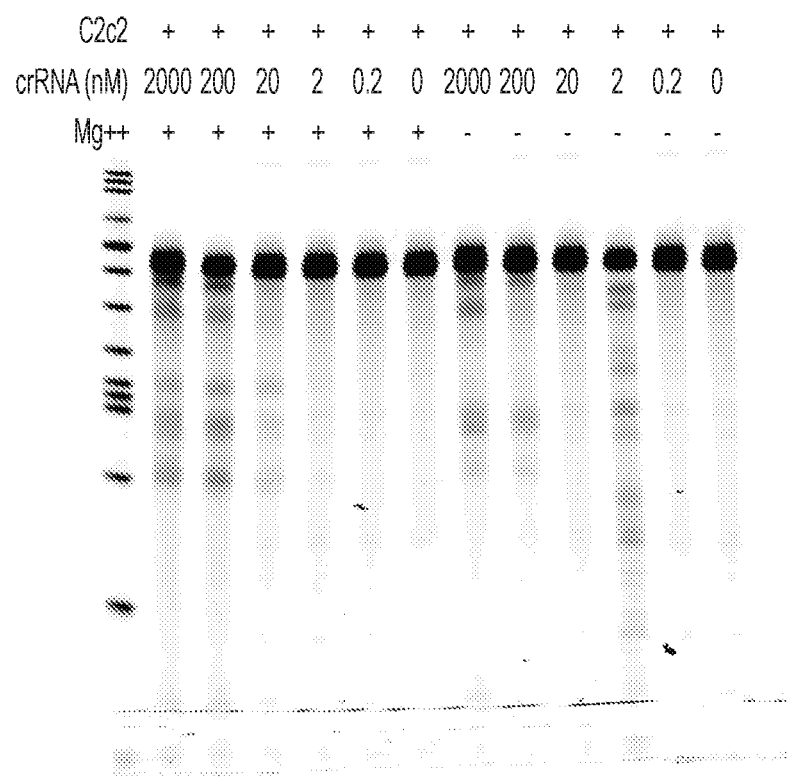
Figure 101:
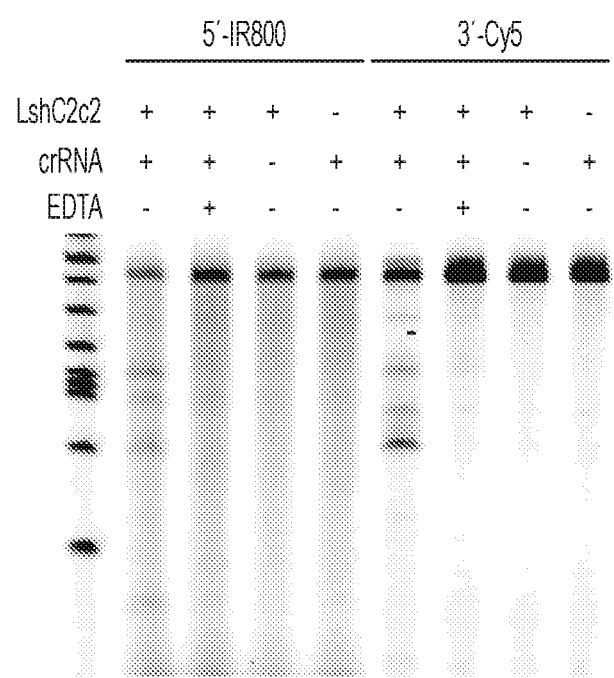
FIG. 101 shows a denaturing gel demonstrating ssRNA cleavage activity of LshC2c2 using an RNA target that is 5' labeled with IRDye 800 and 3' labeled with Cy5. Four independent cleavage sites are observed. This figures also shows the effect of Mg++ chelation on ssRNA cleavage activity.

FIG. 100A-100B shows the effects of divalent cations on C2c2 activity.

Figure 102:
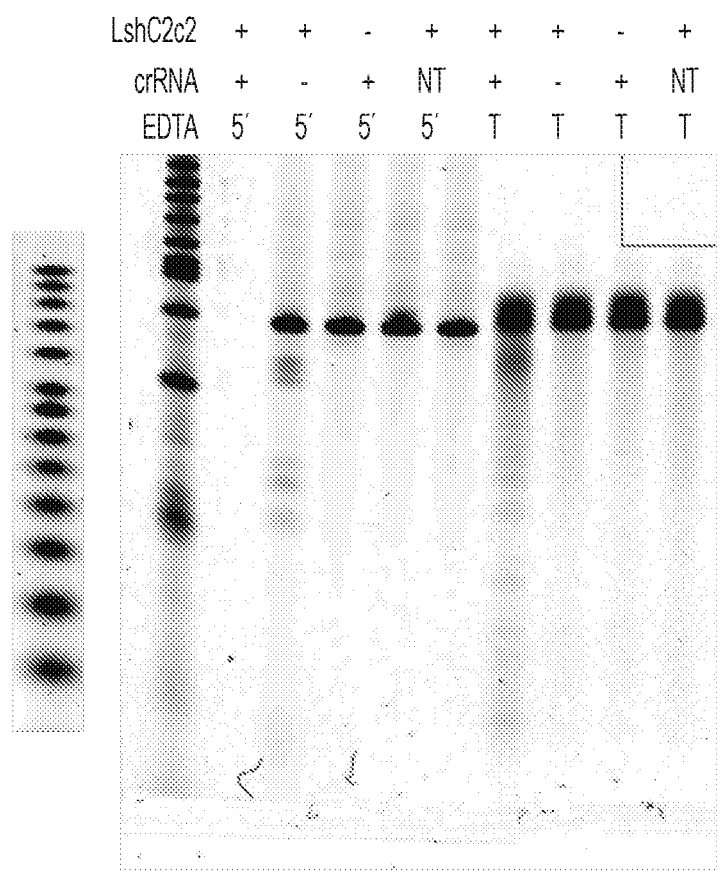
FIG. 102 demonstrates that C2c2 cuts 3' of the target site.

It was shows that C2c2 cuts 3' of the target site (FIG. 102 and FIG. 103)

Figure 104:
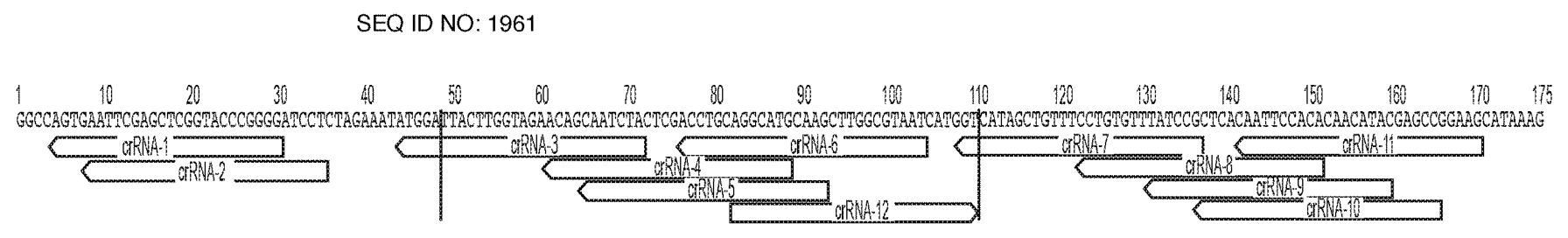
Figure 105:
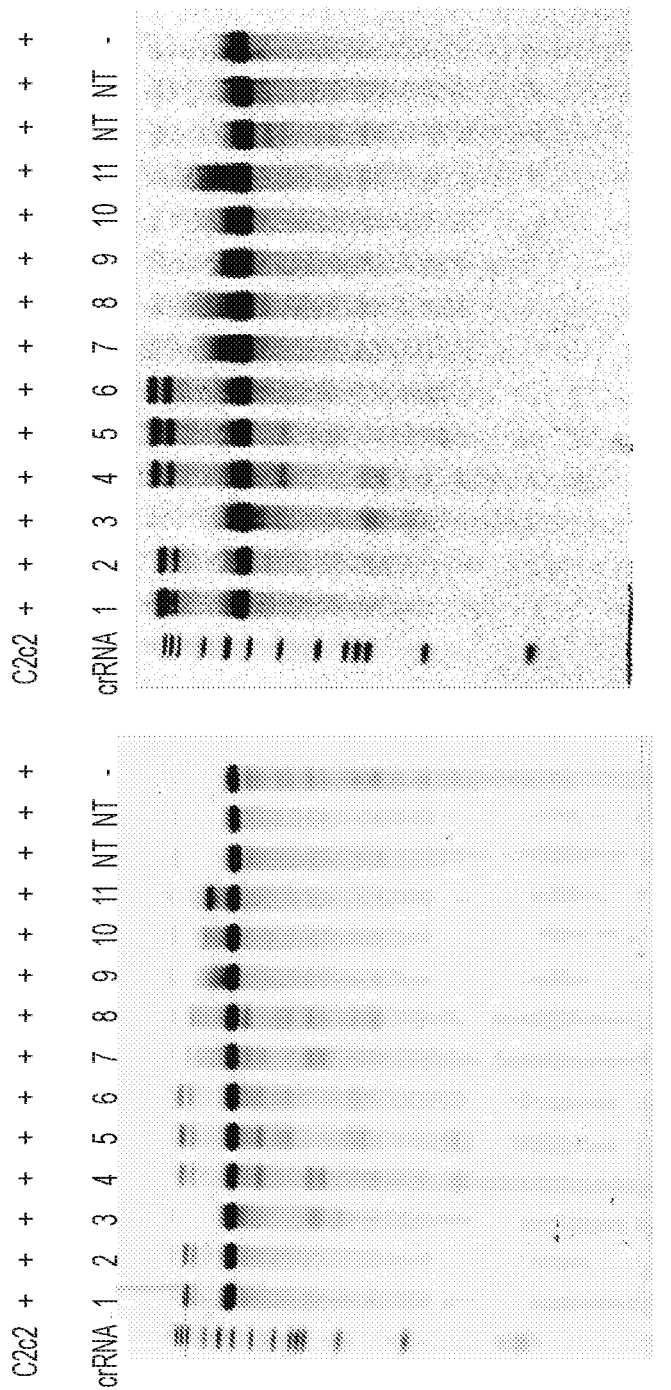
FIG. 105 shows C2c2 reprogramming with crRNAs.
Figure 106:
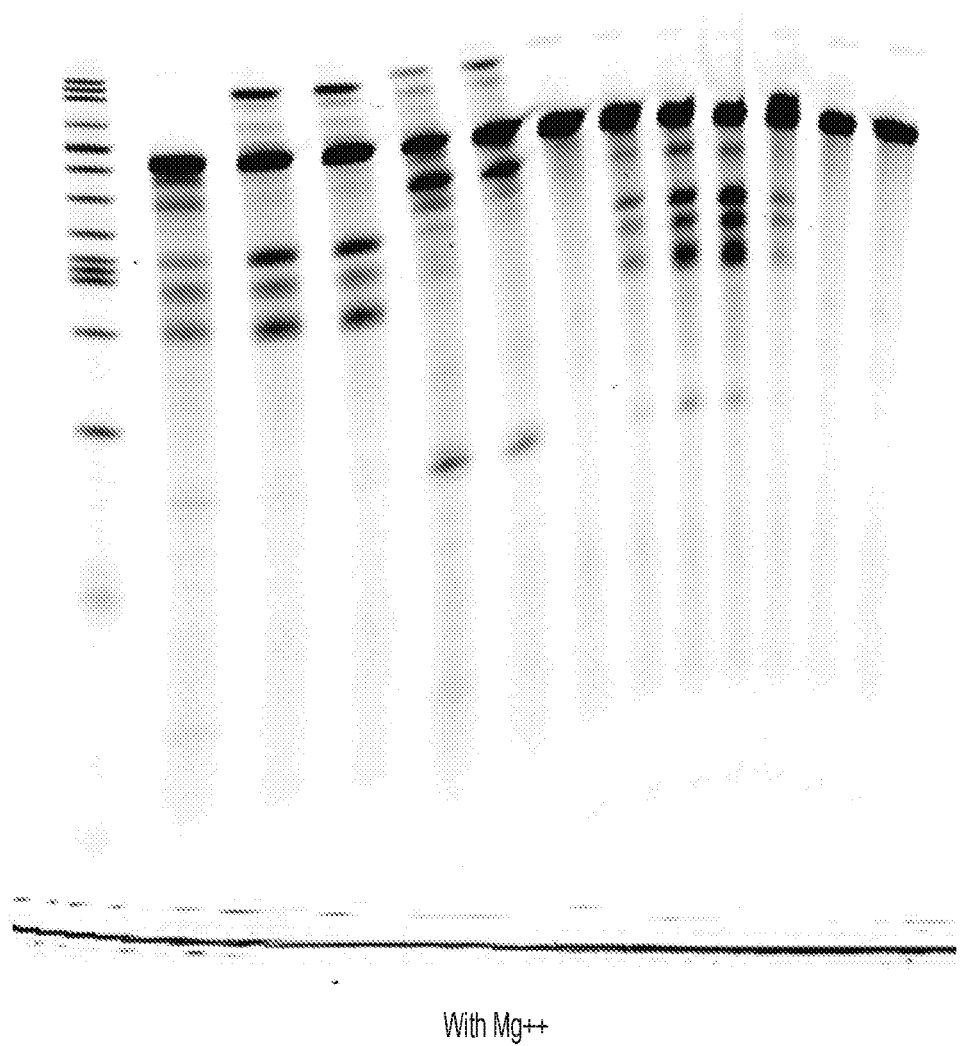
FIG. 106 shows C2c2 reprogramming with crRNAs.

FIGS. 104-106 show that C2c2 can be reprogrammed with crRNAs.

Figure 98:
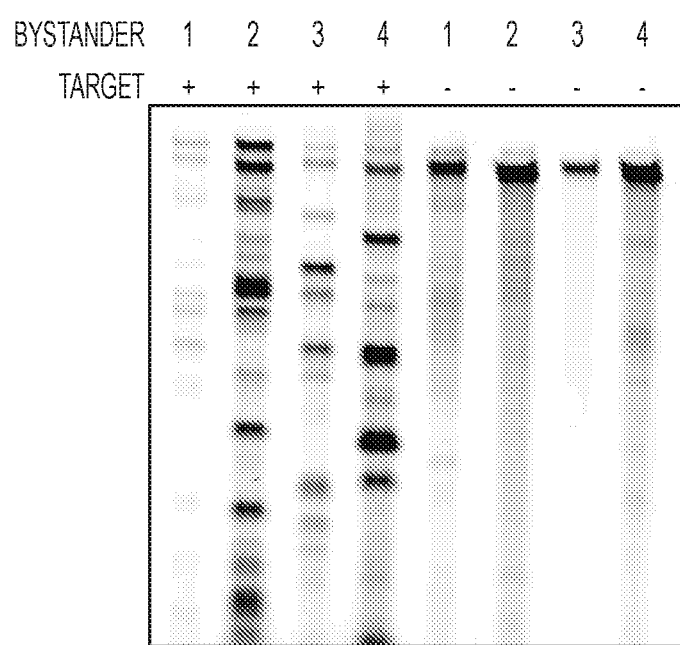
FIG. 98 shows bystander effect. Once active, C2c2 seems to become active and degrade other RNAs in the sample. Top panel: L=long target, small=small target, LC=long target with C PAM. Bottom panel: effect of presence or absence of activator target on cleavage of different bystander targets.
Figure 99A:
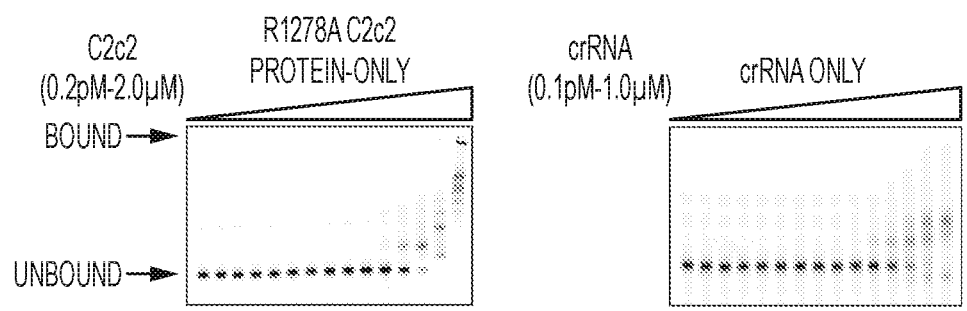
FIG. 99A-99C.
Figure 99B:
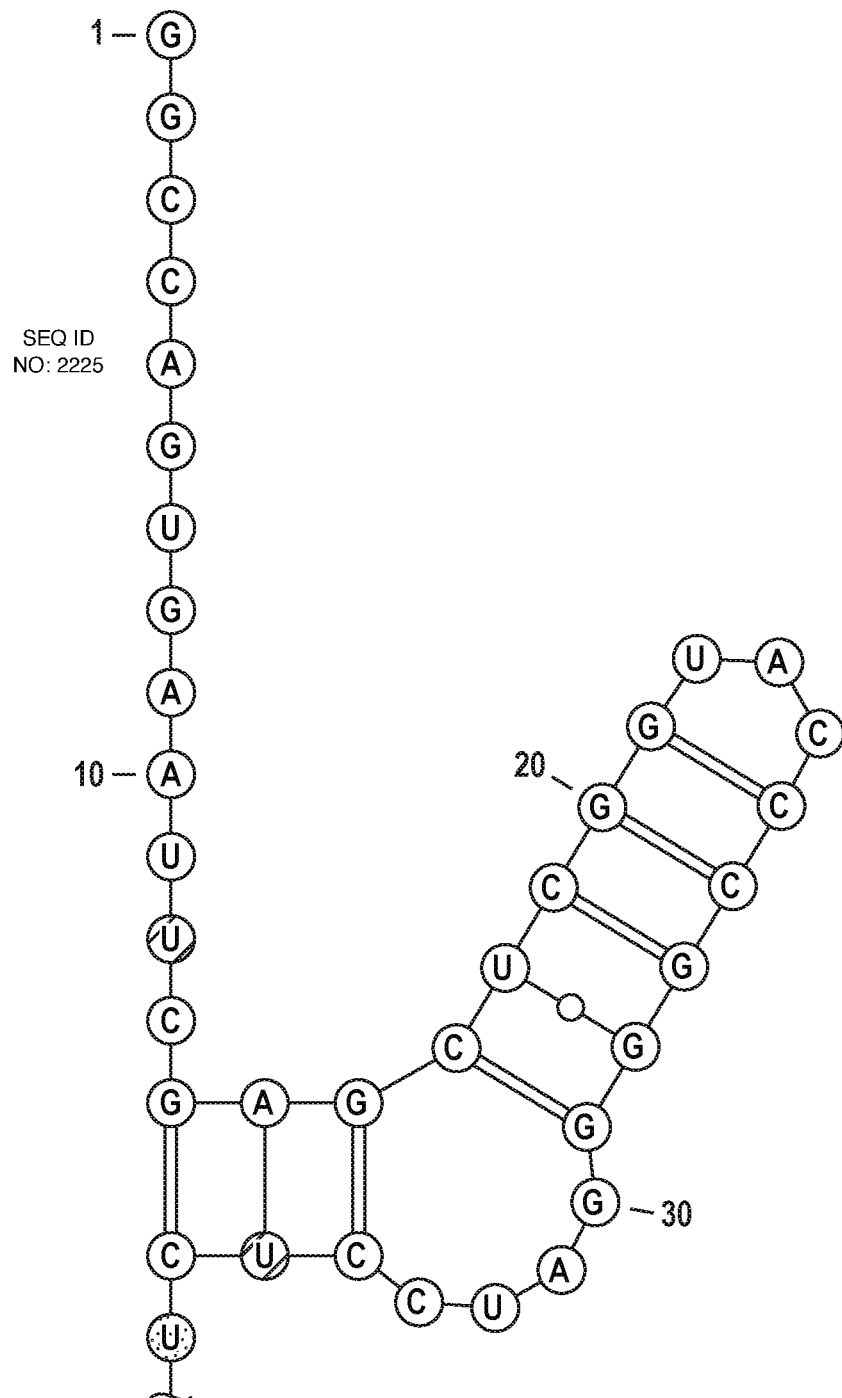
Figure 99B:
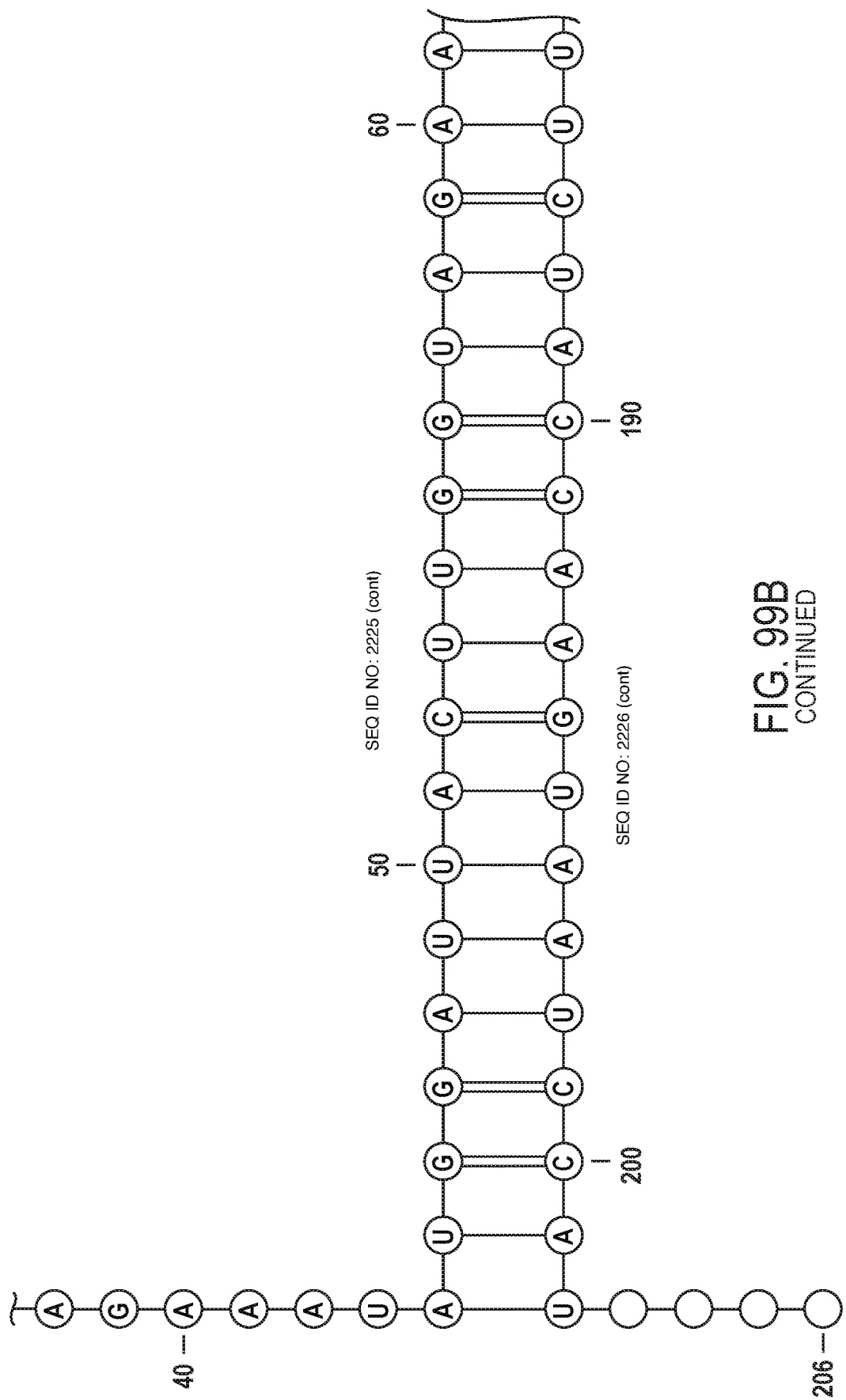
Figure 99B:
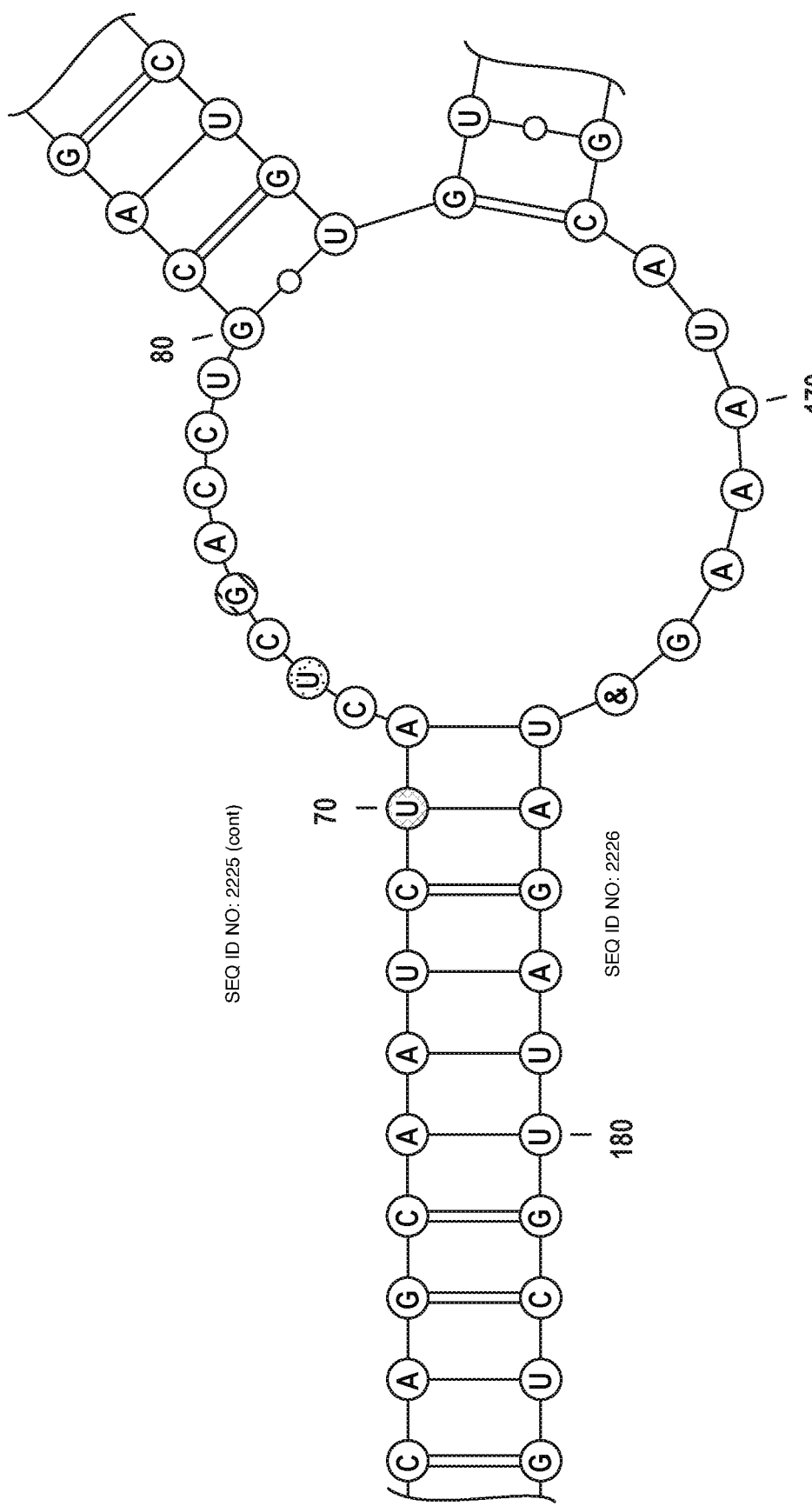
Figure 99B:
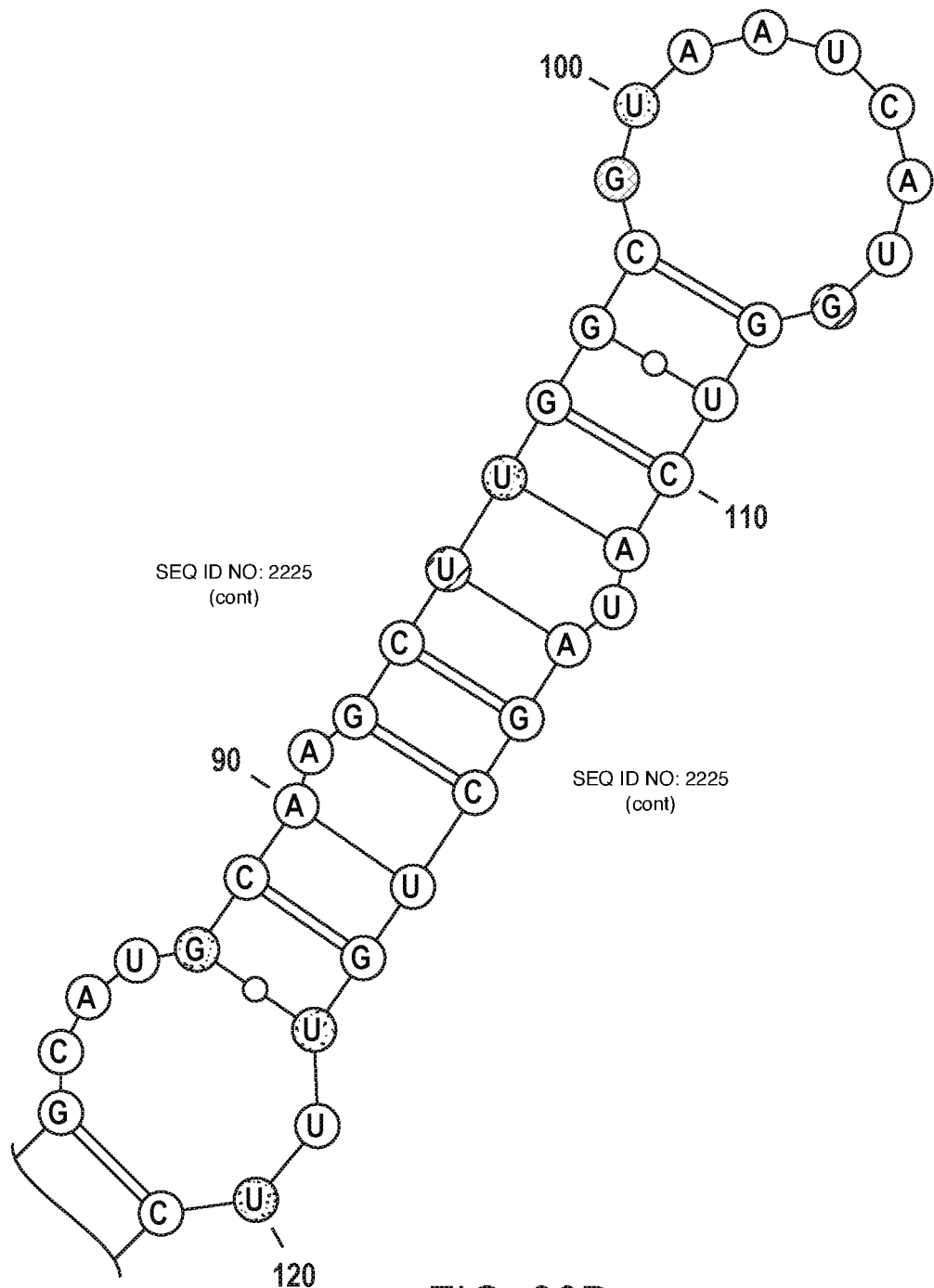
Figure 99B:
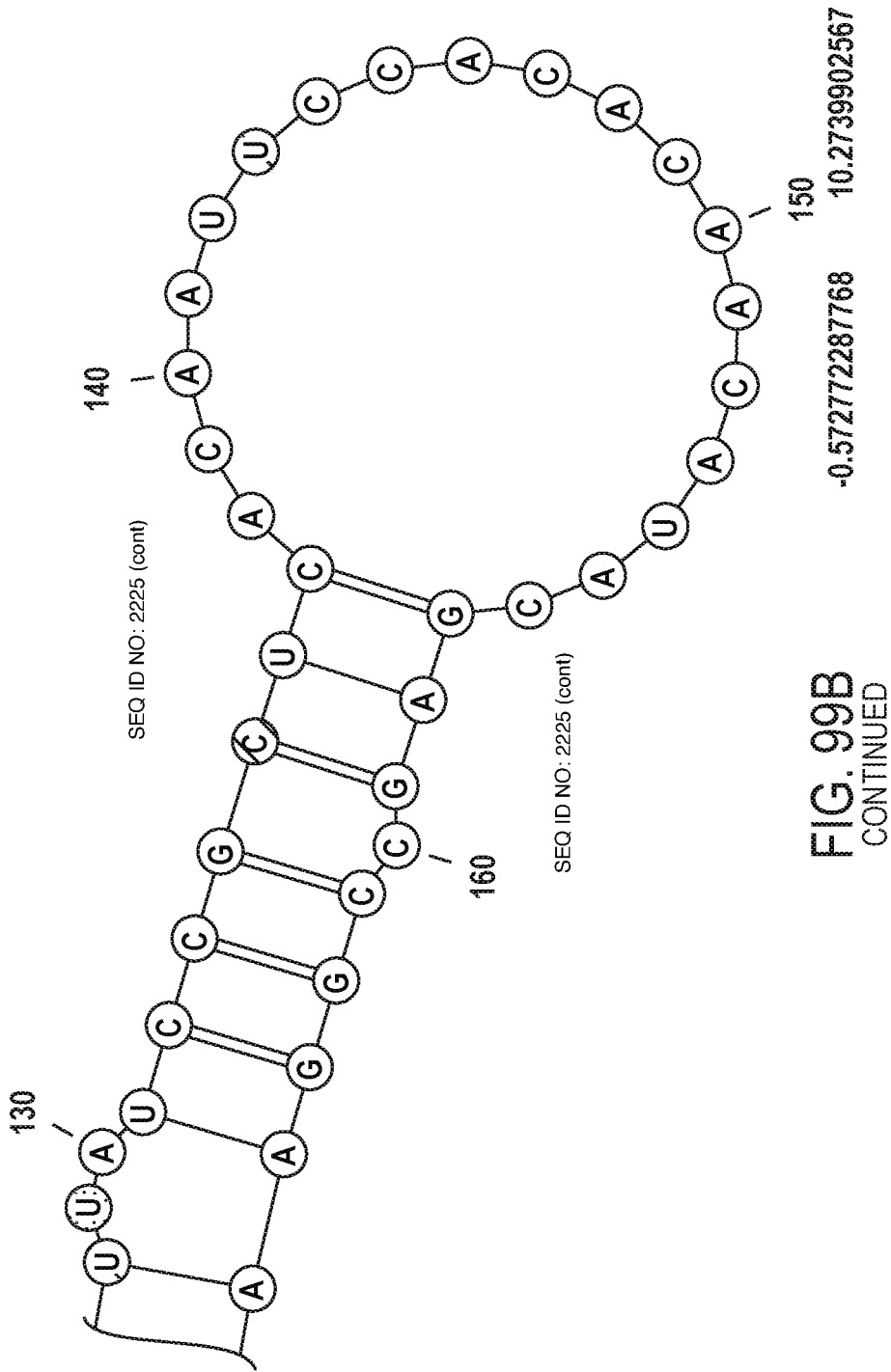
Figure 99B:
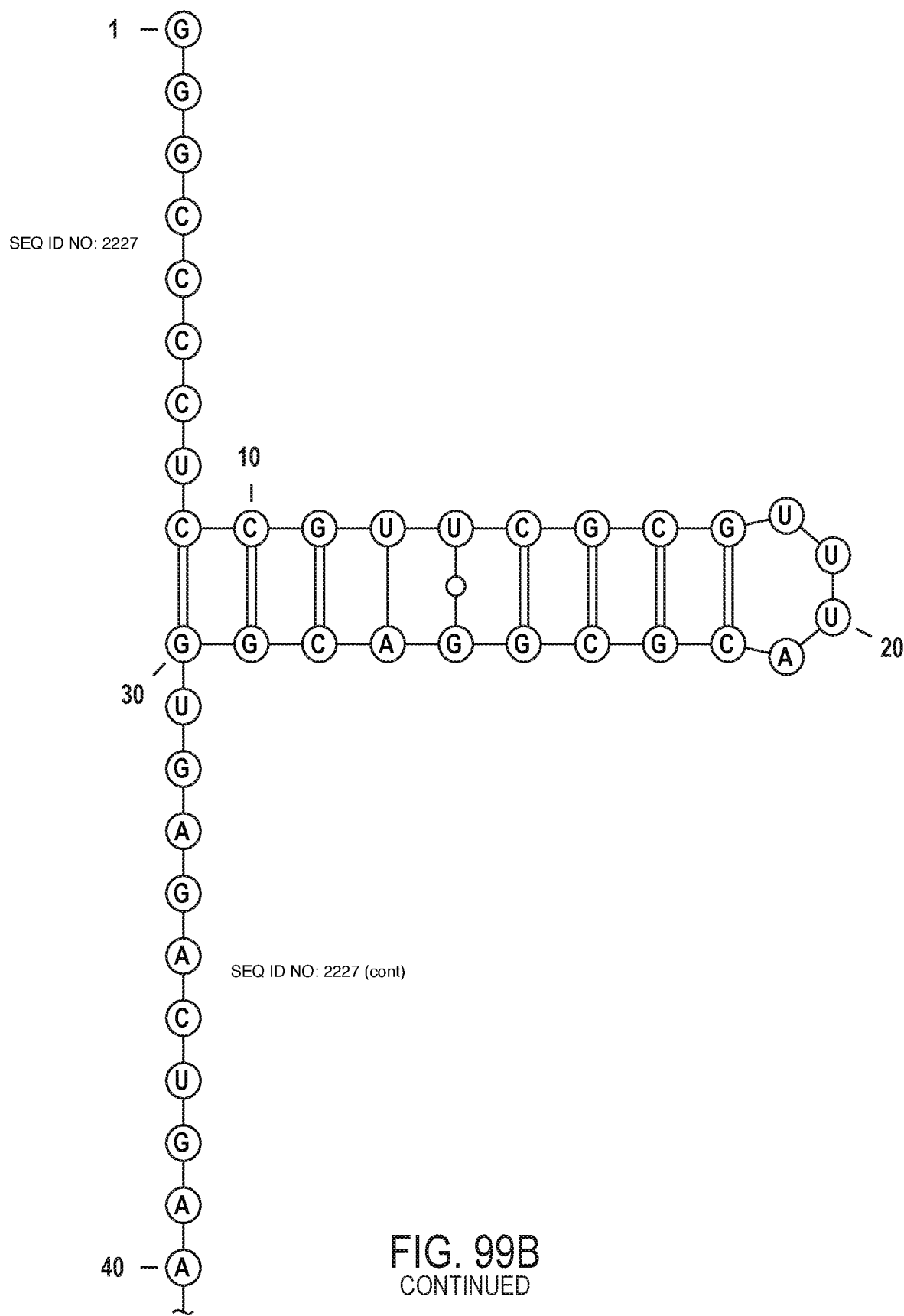
Figure 99B:
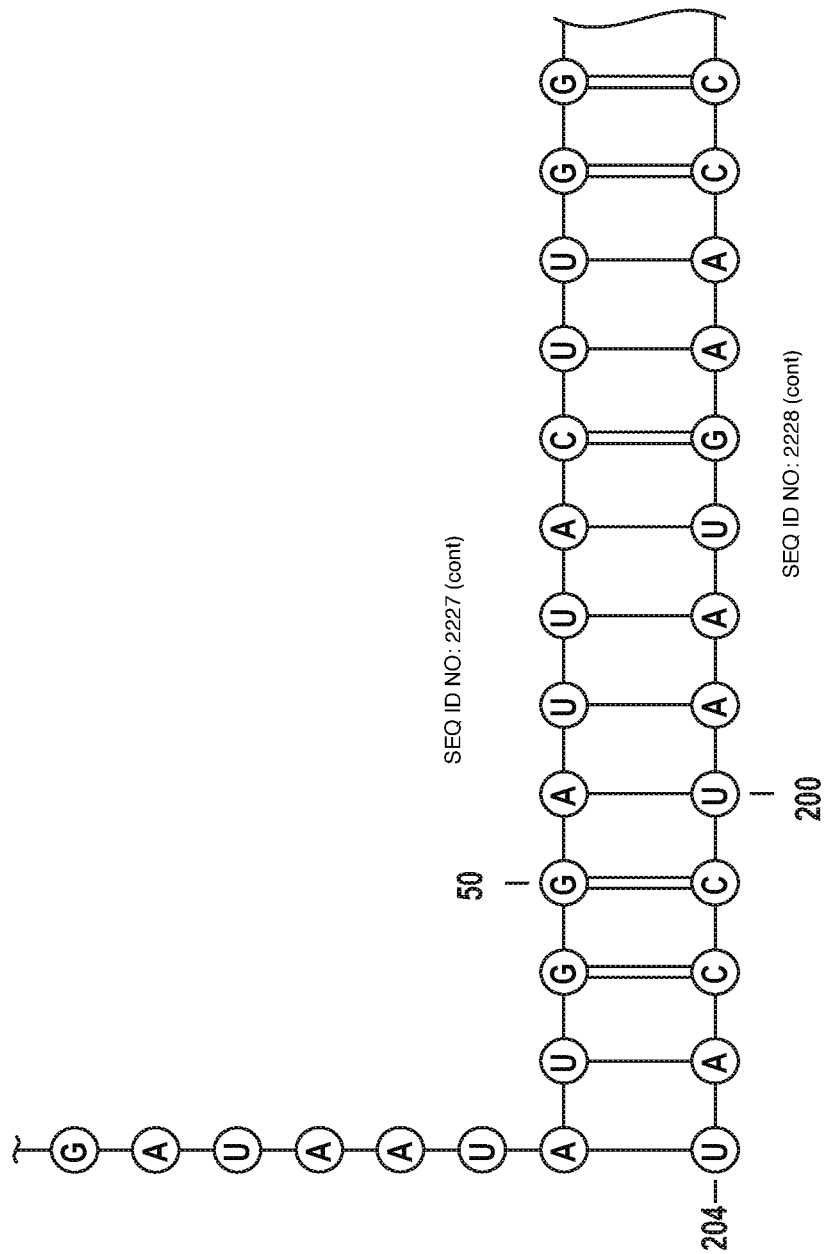
Figure 99B:
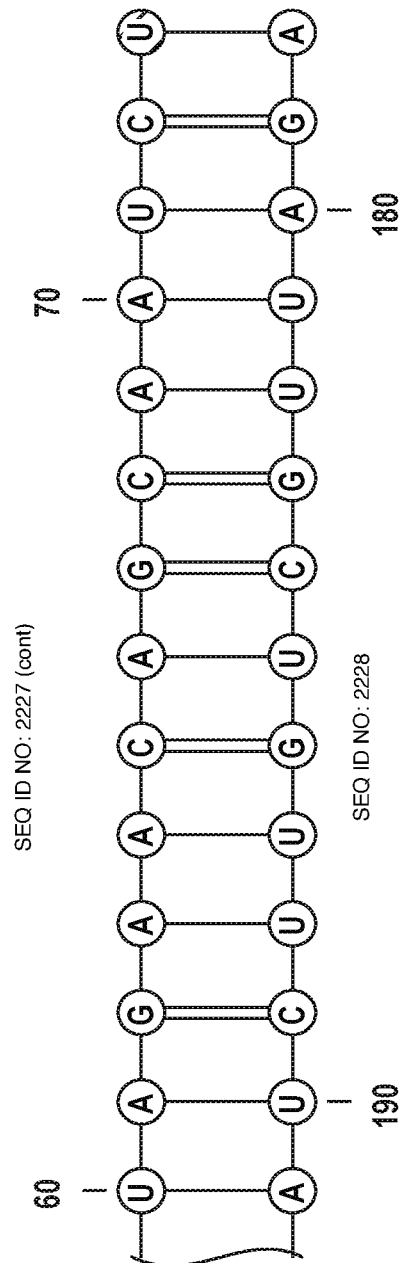
Figure 99B:
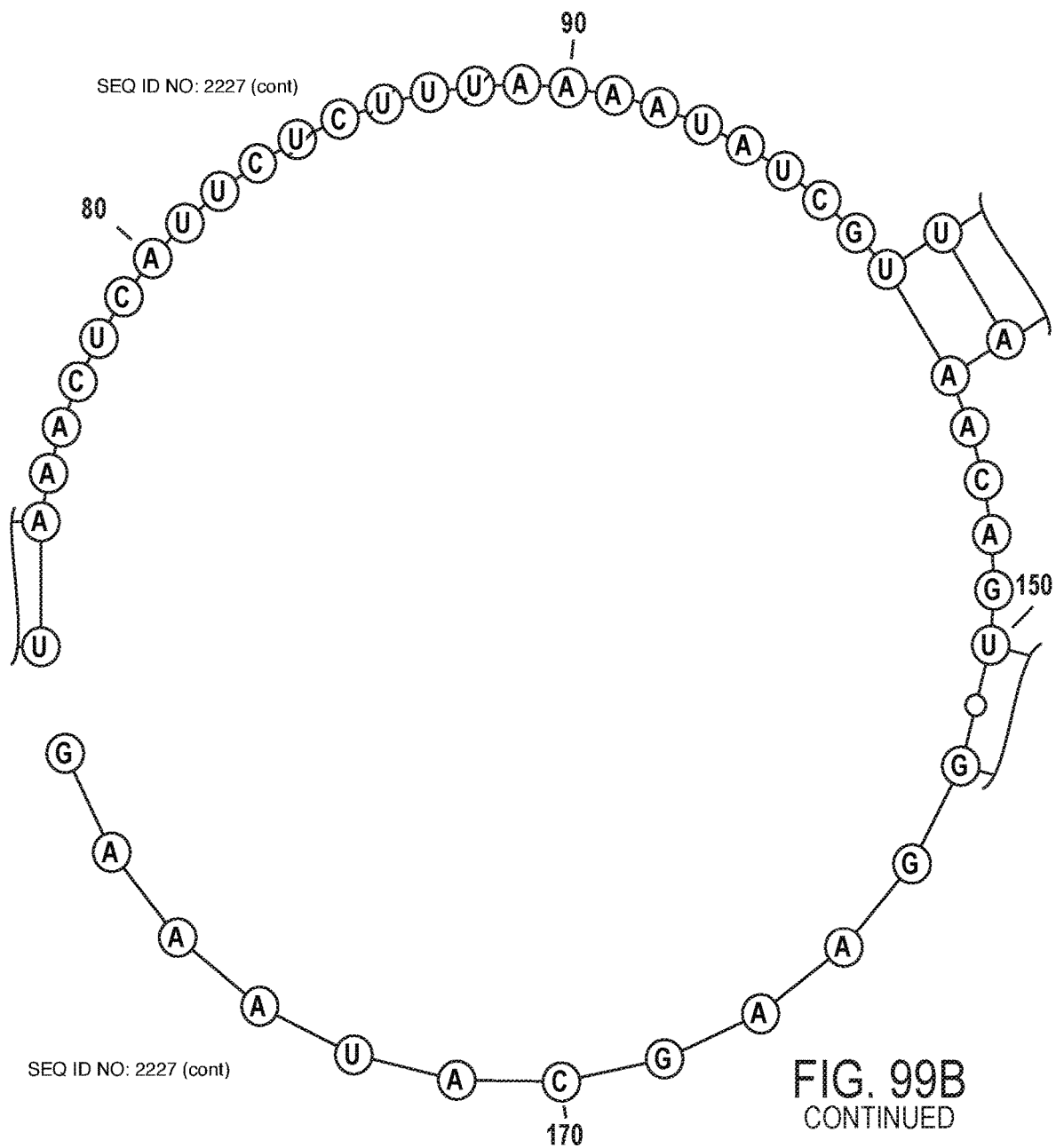
Figure 99B:
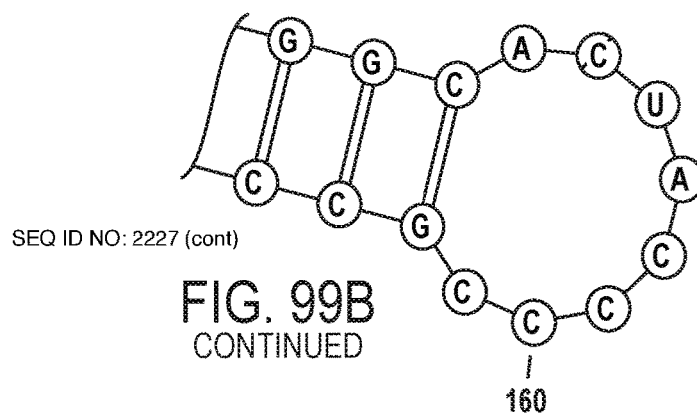
Figure 99B:
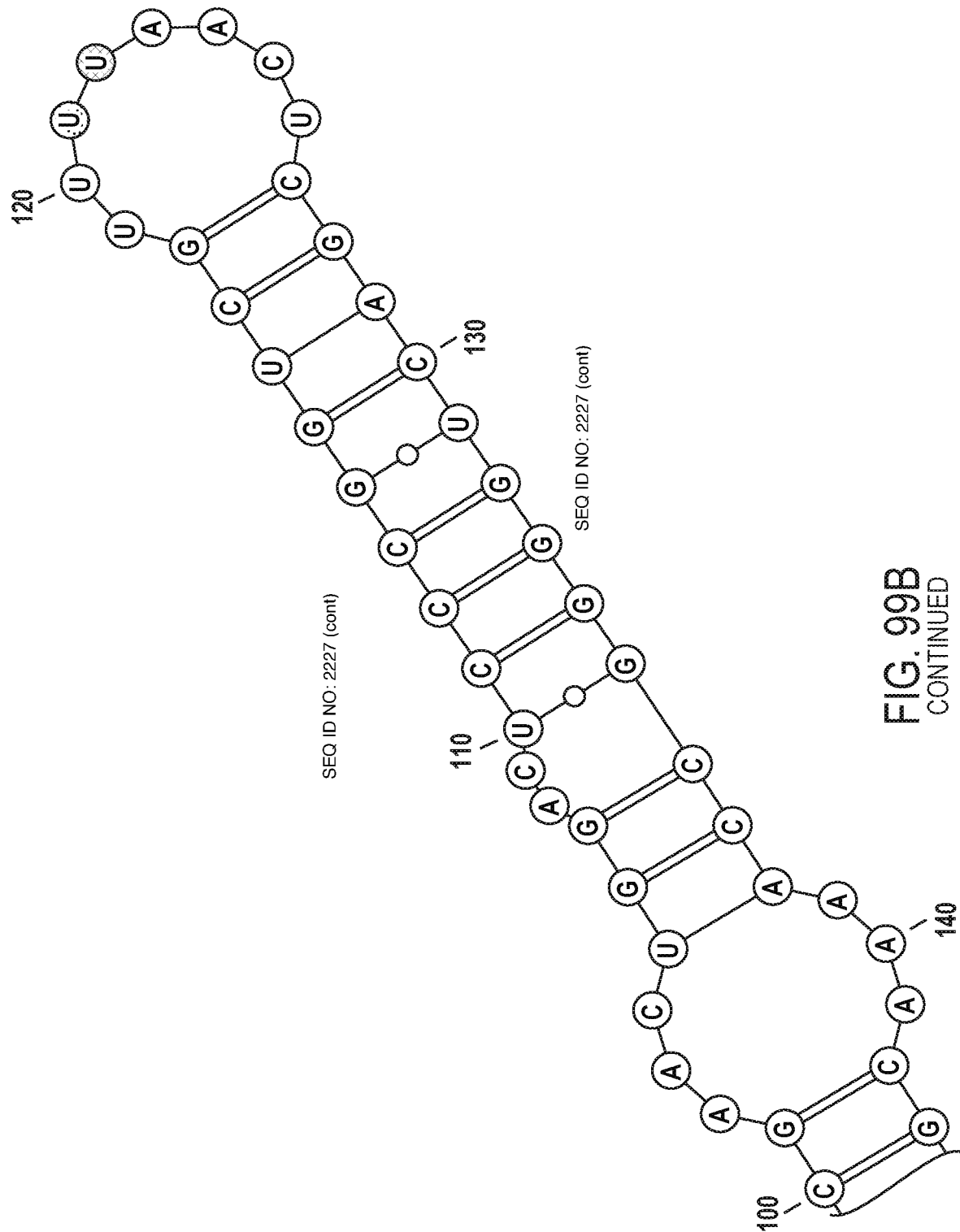
Figure 99C:
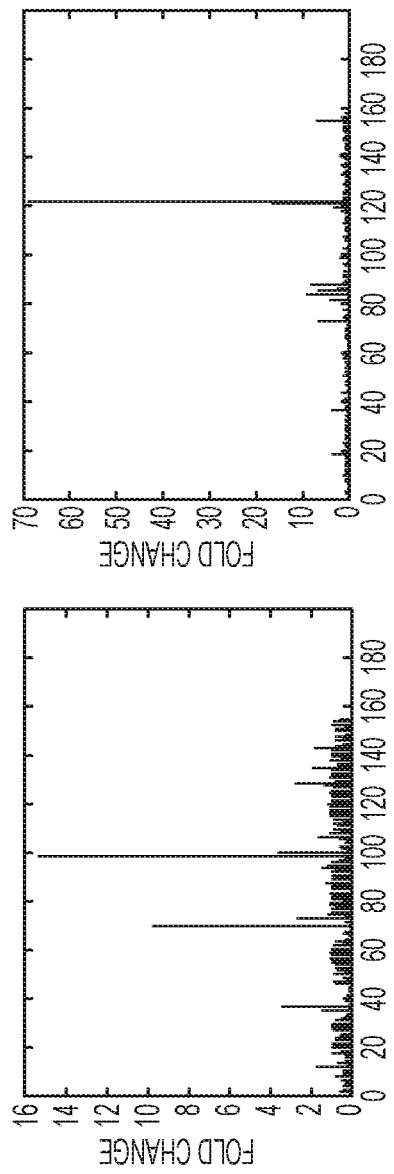

Without wishing to be bound by theory, it seems that one active, C2c2 becomes active and degrades other RNAs (FIG. 98; FIG. 108).

Figure 107:
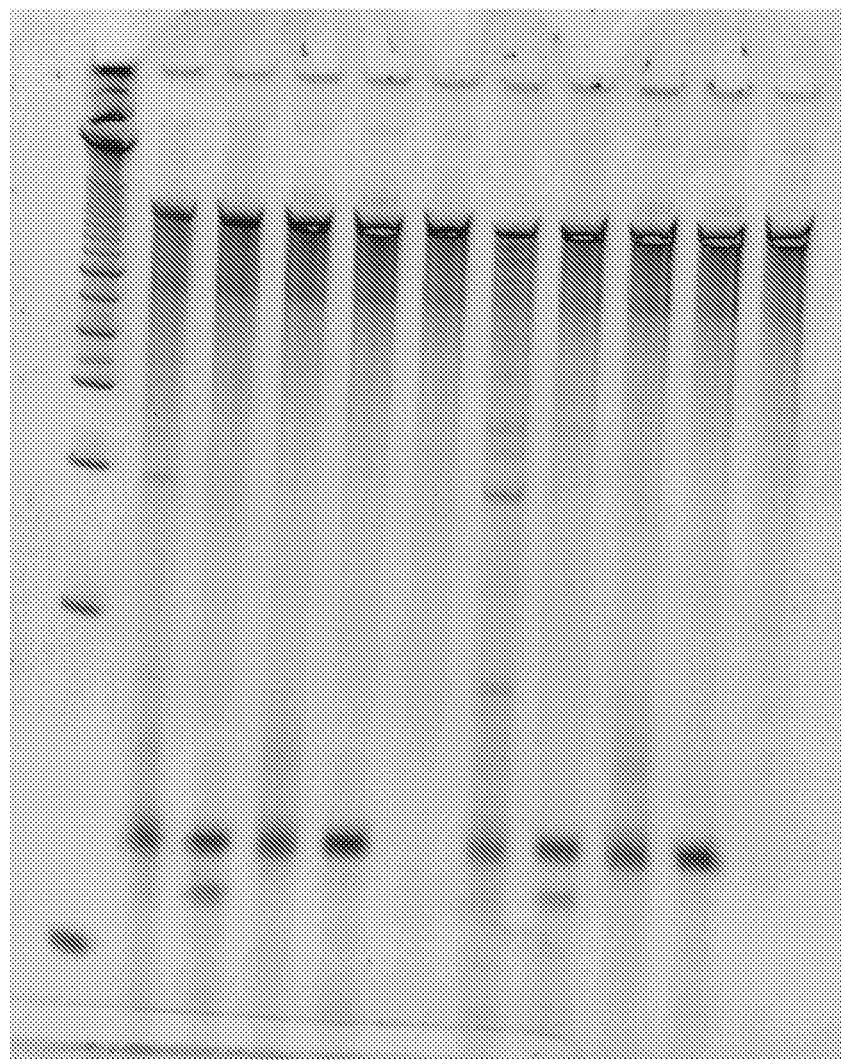
FIG. 107 shows IVC (in vitro nuclease reaction) of a long target.

It was shown that C2c2 may be reprogrammed with crRNAs (FIGS. 104-106), and that long targets may be targeted (FIG. 107)

FIG. 112A-112D suggests that C2c2 crRNAs have a seed region, as indicated by single and double mismatch analysis. Indeed, double mismatch in nt 1-11 of target significantly affects cleavage while less so if in region spanning nt 16-26. These figures also demonstrate specificity of cleavage of C2c2 effector protein.

FIG. 113-1-113-3 and FIG. 114A-114B-2. Suggest that changing sequence contexts affects cleavage patterns. Indeed target sequences provided in different context are cleaved differently.

Example 5: Mutation of Either HEPN Domain Abolishes Targeted Cleavage

Figure 72:
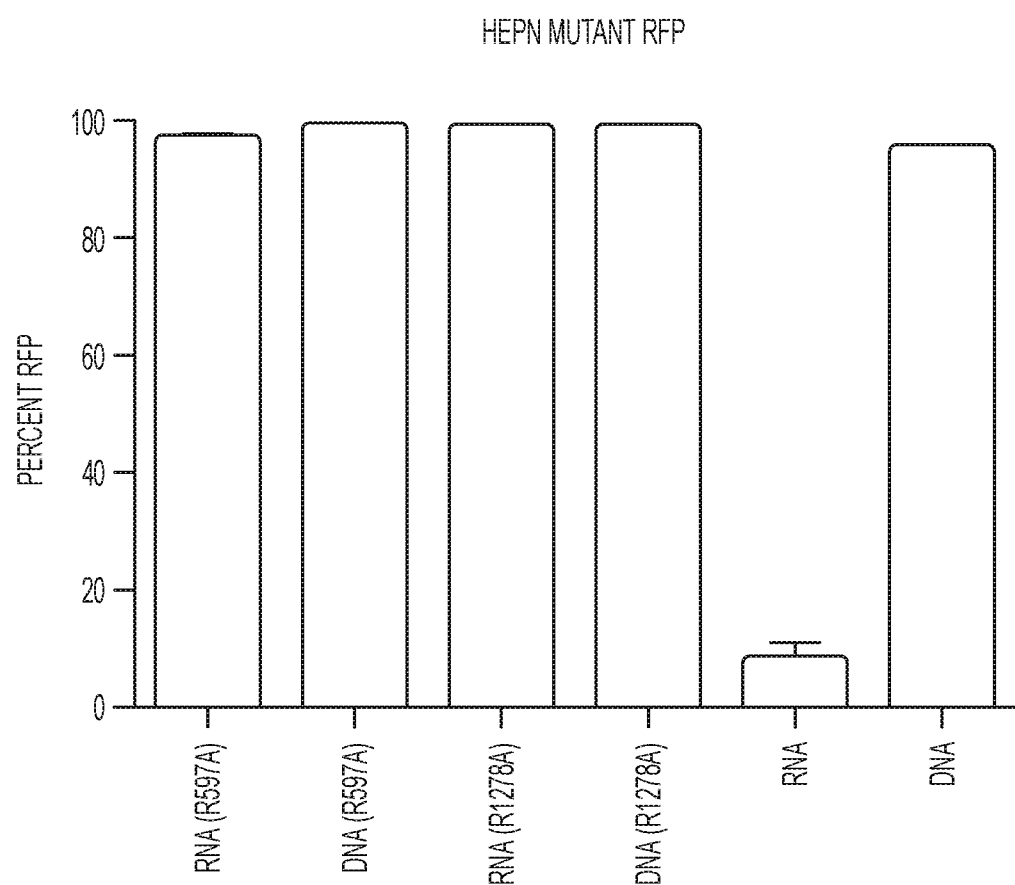
FIG. 72 shows mutation of either HEPN domain abolishes RNA targeting.
Figure 95:
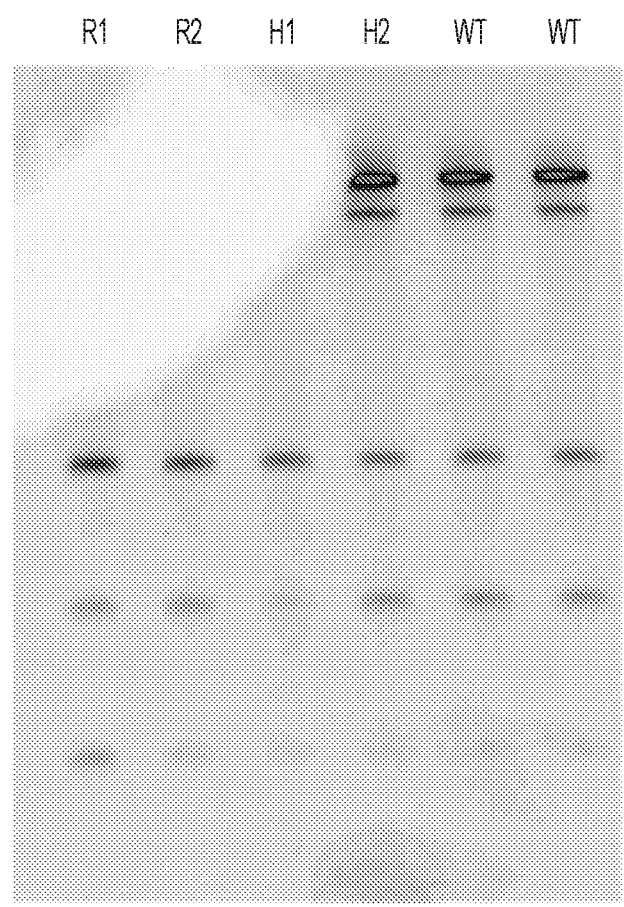
Figure 96:
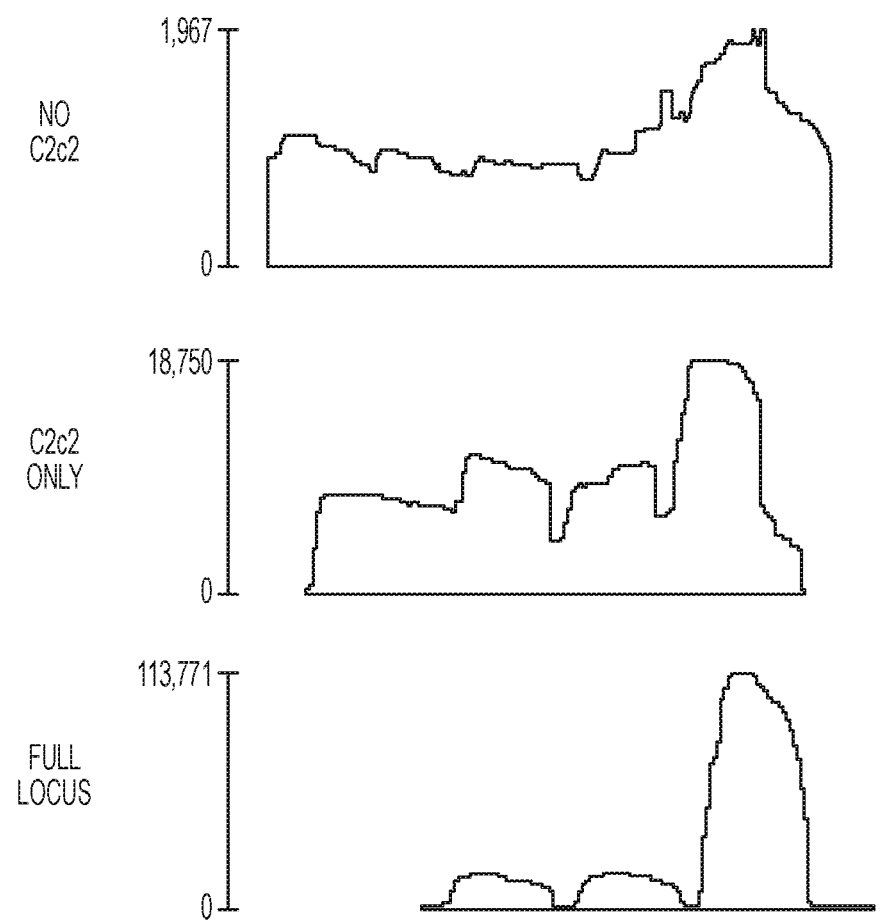
FIG. 96 demonstrates that processing of the C2c2 array in *E. coli* requires the C2c2 protein.
Figure 97A:
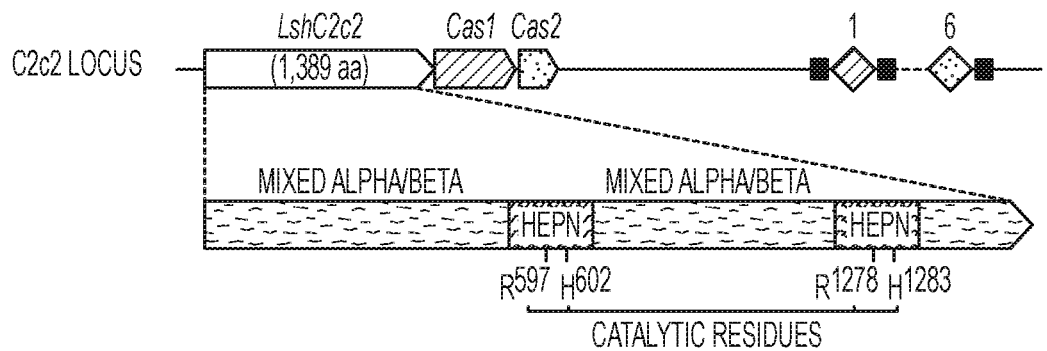
Figure 97B:
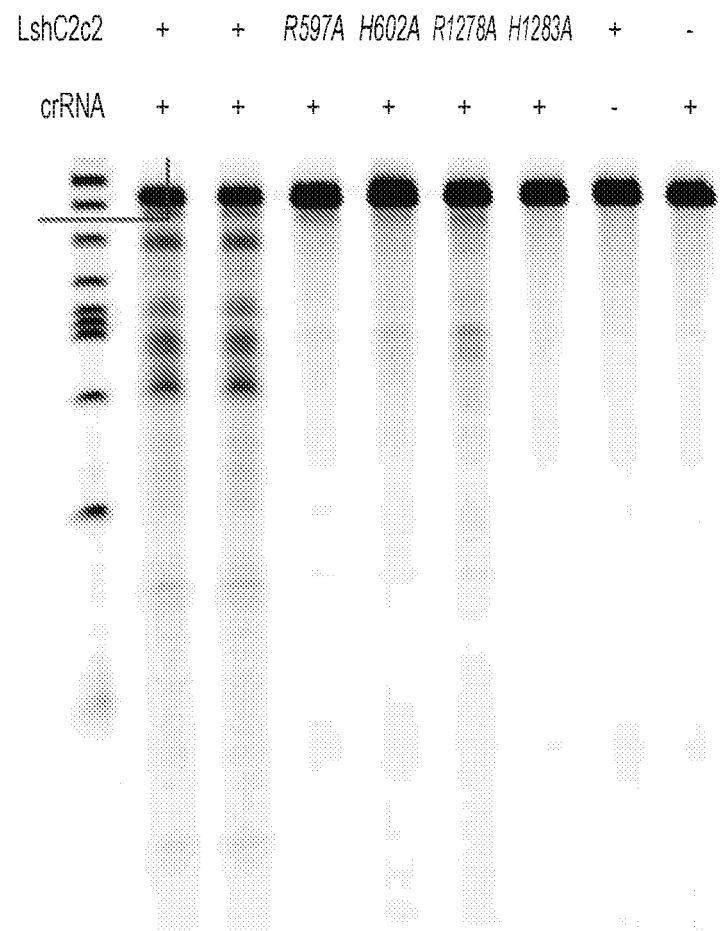
Figure 97D:
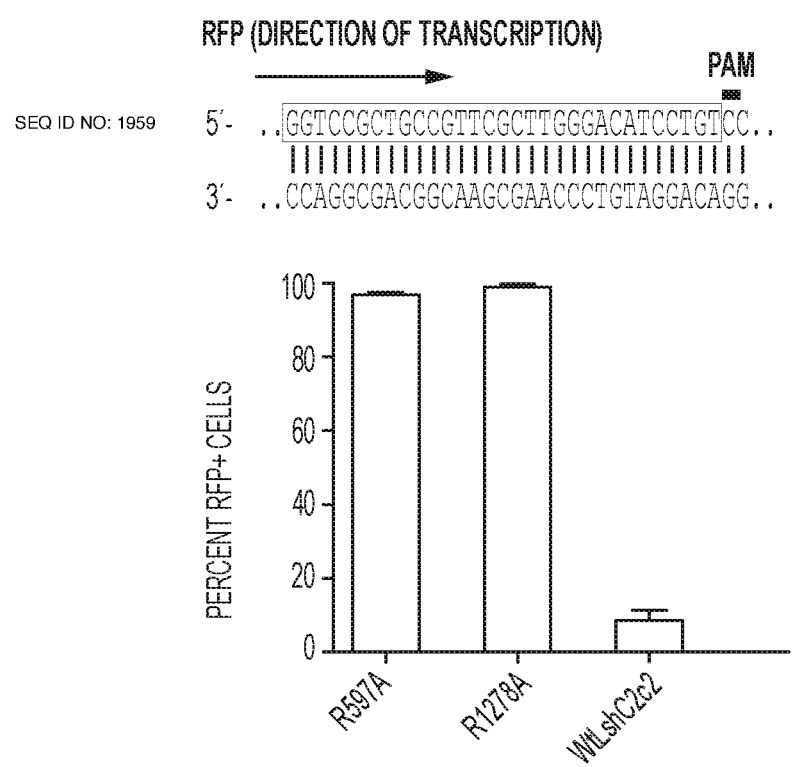

Cpc2 variants were created comprising the mutations R597A and R1278A. As shown in FIG. 72, both mutations abolished RNA cleavage, see also FIG. 97A-97D, demonstrating that R597A, H602A, R1278A, and H1283A abolish RNA cleavage HEPN mutants however still process natural array (FIG. 95).

Figure 111:
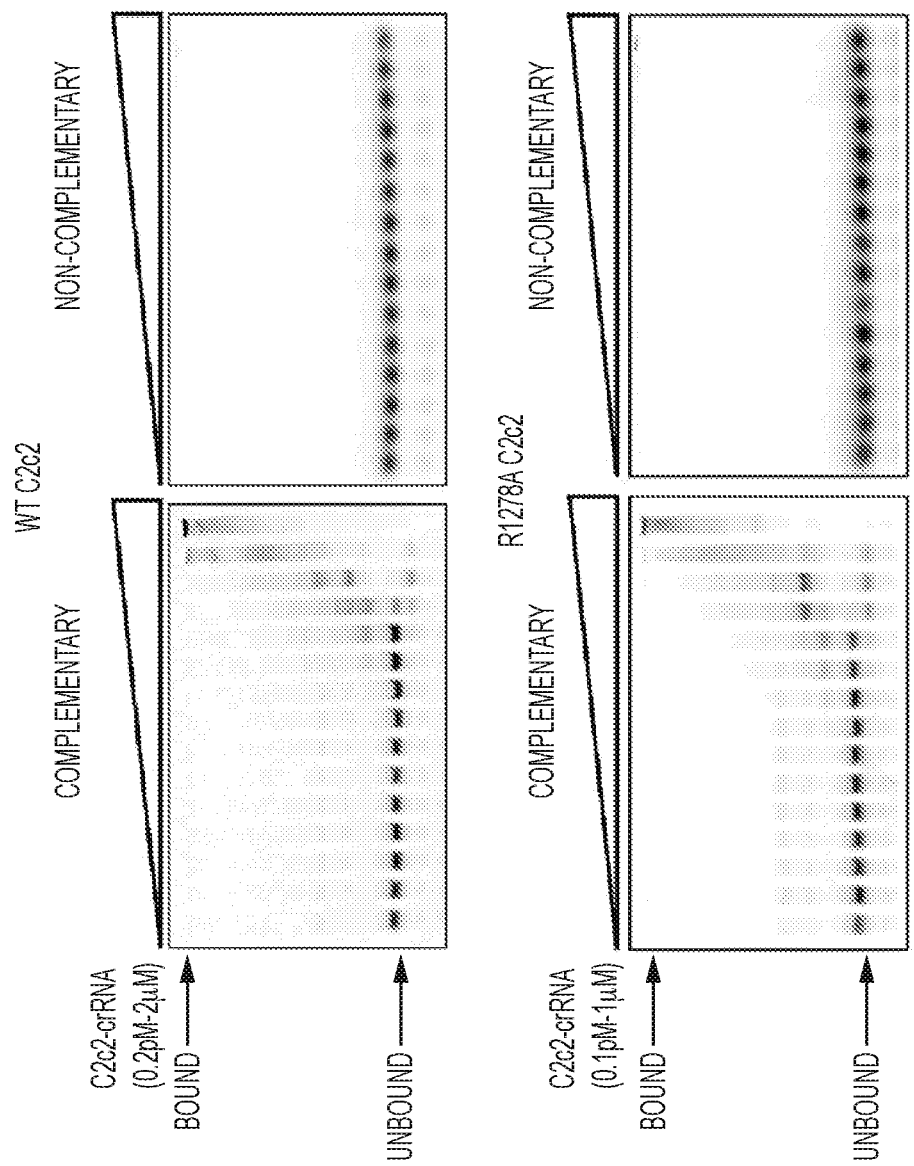
FIG. 111. Demonstrates that C2c2 HEPN mutains retain targeted binding activity. Top panels: electrophoretic mobility shift assay with wild type LshC2c2-crRNA complex against on-target ssRNA and non-targeting complementary ssRNA. Bottom panels: electrophoretic mobility shift assay with HEPN mutant R1278A LshC2c2-crRNA complex against on-target ssRNA and non-targeting complementary ssRNA.

HEPN mutants still retain targeted binding activity, as demonstrated by FIG. 111 (EMSA analysis). Top panel: binding of wild type C2c2. Bottom panel: binding of R1278A mutated Lsh C2c2.

Example 6

Figures 1, 109:
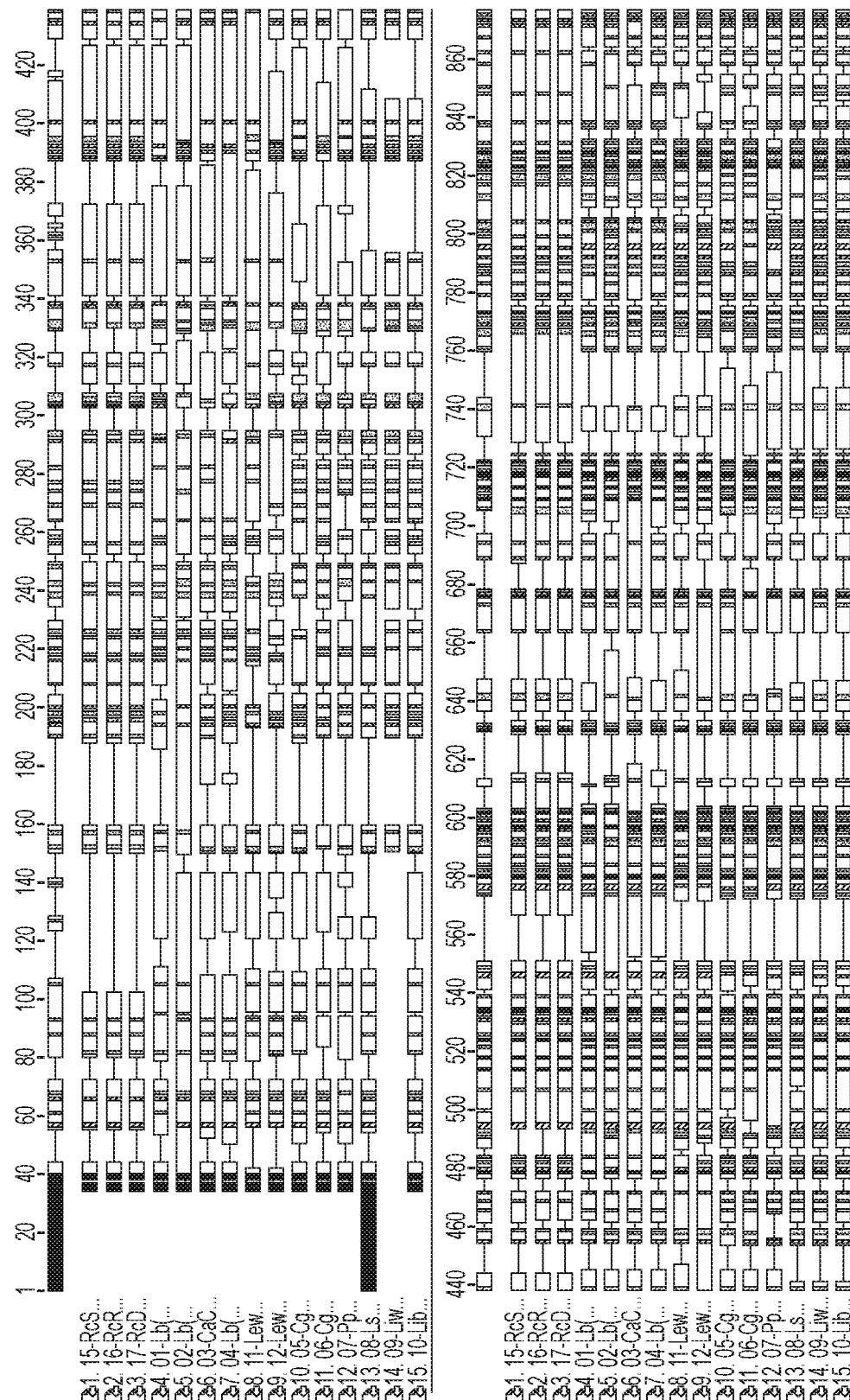
Figures 2, 109:
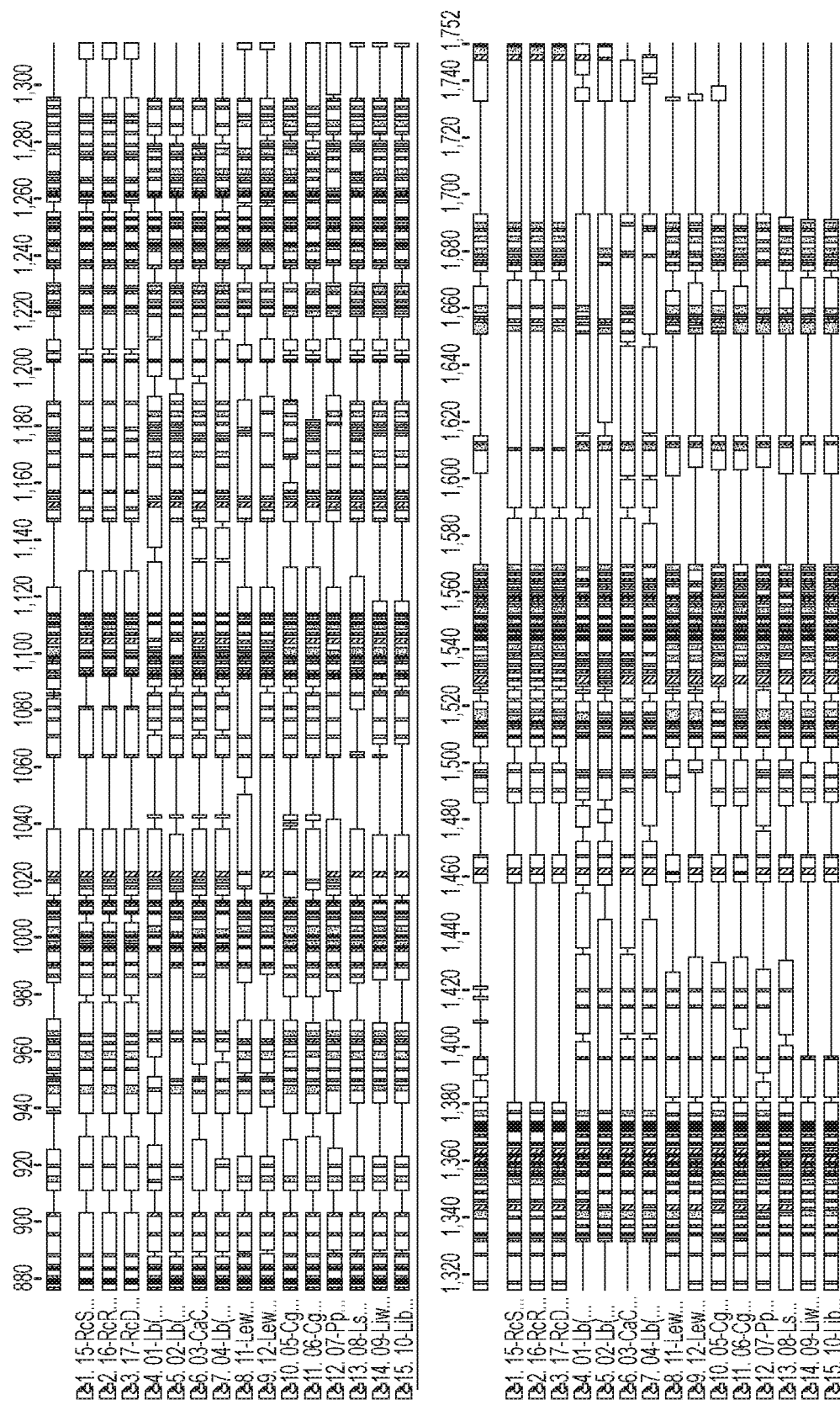
Figure 110:
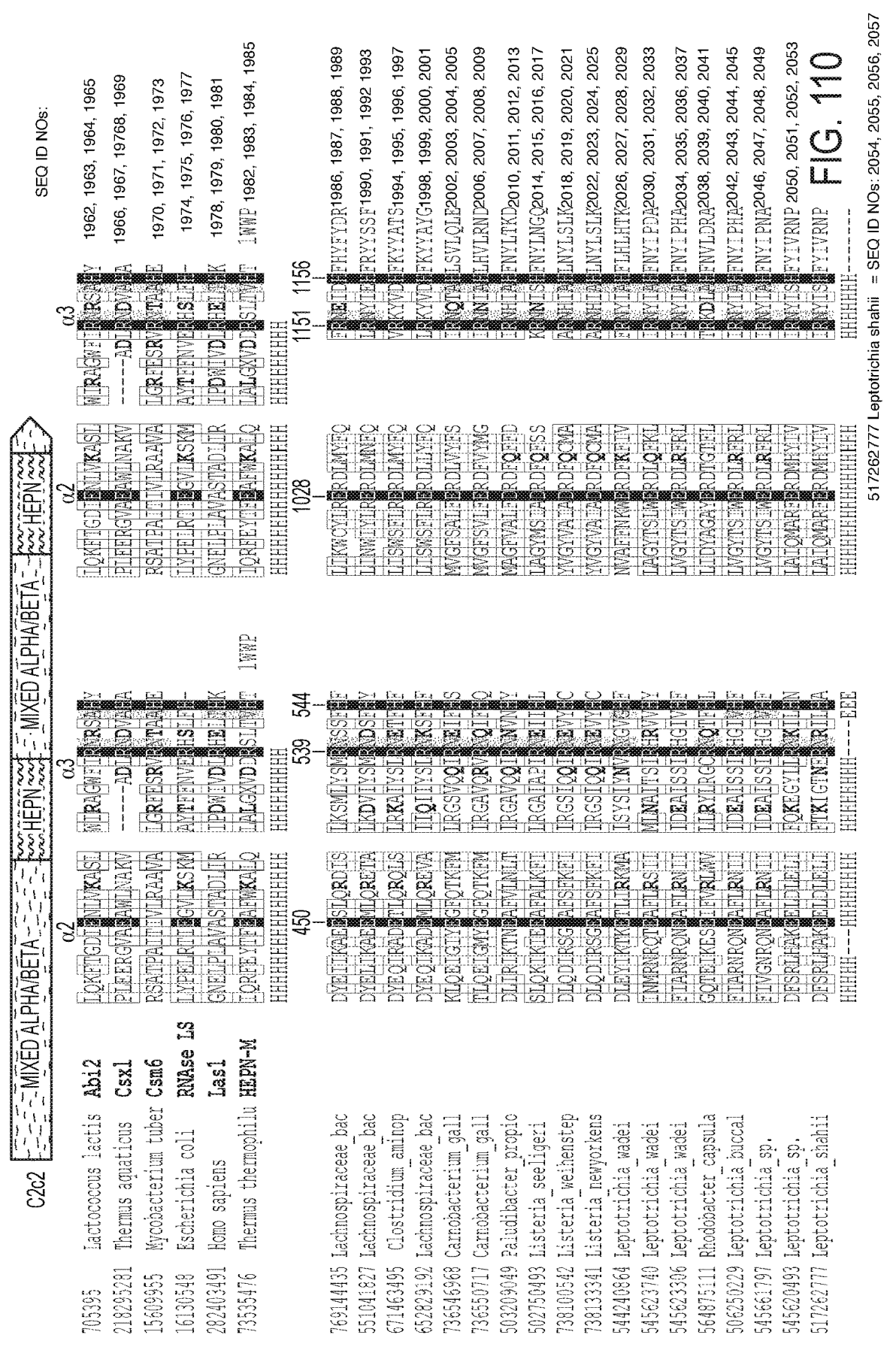

Corresponding residues in other C2c2 orthologs were identified by structural alignment to identify structural representatives that correspond to either their experimentally determined structures or homology models. FIG. 109-1- 109-2 illustrates the sequences alignment of the following orthologs of the *Leptotrichia shahii* DSM 19757 C2c2; *Rhodobacter capsulatus* SB 1003 (RcS); *Rhodobacter capsulatus* R121 (RcR); *Rhodobacter capsulatus* DE442 (RcD); *Lachnospiraceae bacterium* MA2020 (Lb(X)); *Lachnospiraceae bacterium* NK4A179 (Lb(X); [*Clostridium*] *aminophilum* DSM 10710 (CaC); *Lachnospiraceae bacterium* NK4A144 (Lb(X); *Leptotrichia wadei* F0279 (Lew); *Leptotrichia wadei* F0279 (Lew); *Carnobacterium gallinarum* DSM 4847 (Cg); *Carnobacterium gallinarum* DSM 4847 (Cg); *Paludibacter propionicigenes* WB4 (Pp); *Listeria seeligeri* serovar 1/2b (Ls); *Listeria weihenstephanensis* FSL R9-0317 (Liw); and *Listeria* bacterium FSL M6-0635 (Lib). FIG. 110 demonstrates that C2c2 orthologues have conserved HEPN domains.

Using the numbering from a consensus sequence obtained using MUSCLE alignment (ebi.ac.uk/Tools/msa/muscle/), the following conserved residues were identified. K36, K39, V40, E479, L514, V518, N524, G534, K535, E580, L597, V602, D630, F676, L709, I713, R717 (HEPN), N718, H722 (HEPN), E773, P823, V828, I879, Y880, F884, Y997, L1001, F1009, L1013, Y1093, L1099, L1111, Y1114, L1203, D1222, Y1244, L1250, L1253, K1261, I1334, L1355, L1359, R1362, Y1366, E1371, R1372, D1373, R1509 (HEPN), H1514 (HEPN), Y1543, D1544, K1546, K1548, V1551, I1558. The pairwise match up of conserved residues in the consensus sequence with amino acids of *Leptotrichia wadei* C2c2 (sequence F herein) is: K36, K2; K39, K5; V40, V6; E479, E301; L514, L331; V518, I335; N524, N341; G534, G351; K535, K352; E580, E375; L597, L392; V602, L396; D630, D403; F676, F446; L709, I466; I713, I470; R717 (HEPN), R474; N718, H475; H722 (HEPN), H479; E773, E508; P823, P556; V828, L561; I879, I595; Y880, Y596; F884, F600; Y997, Y669; L1001, I673; F1009, F681; L1013, L685; Y1093, Y761; L1099, L676; L1111, L779; Y1114, Y782; L1203, L836; D1222, D847; Y1244, Y863; L1250, L869; L1253, I872; K1261, K879; I1334, I933; L1355, L954; L1359, I958; R1362, R961; Y1366, Y965; E1371, E970; R1372, R971; D1373, D972; R1509 (HEPN), R1046; H1514 (HEPN), H1051; Y1543, Y1075; D1544, D1076; K1546, K1078; K1548, K1080; V1551, I1083; I1558, I1090.

Example 7: Generation of C2c2 Mutants with Enhanced Specificity

Recently a method was described for the generation of Cas9 orthologs with enhanced specificity (Slaymaker et al. 2015). This strategy can be used to enhance the specificity of C2c2 orthologs. Primary residues for mutagenesis are all positive charges residues within the HEPN domain, since this is the only known structure in the absence of a crystal and we know that specificity mutants in RuvC worked in Cas9. The conserved Arginine residues within HEPN domain are R717 and R1509.

Additional candidates are positive charged residues that are conserved between different orthologs, such as K2, K39, K535, K1261, R1362, R1372, K1546 and K1548.

These can be used to generate C2c2 mutants with enhanced specificity.

Example 8: C2c2 is a Single-Component Programmable RNA-Guided RNA-Targeting CRSPR Effector

TABLE 10A crRNA sequences used for in vitro experiments.

| Name | Sequence | 1st FIG. | SEQ ID NO: |
|---|---|---|---|
| crRNA 14 | CCACCCCAAUAUCGAAGGGGACUAAAACUAGAUUGCUGUUCUACCAAGUAAUCCAU | 117B | 72 |
| crRNA 15 | CCACCCCAAUAUCGAAGGGGACUAAAACUUUCUAGAGGAUCCCCGGGUACCGAGCU | 117D | 73 |
| crRNA 16 | CCACCCCAAUAUCGAAGGGGACUAAAACAGUAAUCCAUAUUUCUAGAGGAUCCCCG | 117D | 74 |
| crRNA 17 | CCACCCCAAUAUCGAAGGGGACUAAAACUAGAUUGCUGUUCUACCAAGUAAUCCAU | 117D | 75 |
| crRNA 18 | CCACCCCAAUAUCGAAGGGGACUAAAACCAUGCCUGCAGGUCGAGUAGAUUGCUGU | 117D | 76 |
| crRNA 19 | CCACCCCAAUAUCGAAGGGGACUAAAACGCAUGCCUGCAGGUCGAGUAGAUUGCUG | 117D | 77 |
| crRNA 20 | CCACCCCAAUAUCGAAGGGGACUAAAACAAGCUUGCAUGCCUGCAGGUCGAGUAGA | 117D | 78 |
| crRNA 21 | CCACCCCAAUAUCGAAGGGGACUAAAACCGCCAAGCUUGCAUGCCUGCAGGUCGAG | 117D | 79 |

TABLE 10A-continued crRNA sequences used for in vitro experiments.

| Name | Sequence | 1st FIG. | SEQ ID NO: |
|---|---|---|---|
| crRNA 22 | CCACCCCAAUAUCGAAGGGGACUAAAACGAUUACGCCAAGCUUGCAUGCCUGCAGG | 117D | 80 |
| crRNA 23 | CCACCCCAAUAUCGAAGGGGACUAAAACUGAUUACGCCAAGCUUGCAUGCCUGCAG | 117D | 81 |
| crRNA 24 | CCACCCCAAUAUCGAAGGGGACUAAAACAUGACCAUGAUUACGCCAAGCUUGCAUG | 117D | 82 |
| crRNA 25 | CCACCCCAAUAUCGAAGGGGACUAAAACUAUGACCAUGAUUACGCCAAGCUUGCAU | 117D | 83 |
| crRNA 26 | CCACCCCAAUAUCGAAGGGGACUAAAACAGCUAUGACCAUGAUUACGCCAAGCUUG | 117D | 84 |
| crRNA 27 | CCACCCCAAUAUCGAAGGGGACUAAAACGAAACAGCUAUGACCAUGAUUACGCCAA | 117D | 85 |
| crRNA 28 | CCACCCCAAUAUCGAAGGGGACUAAAACACAGGAAACAGCUAUGACCAUGAUUACG | 117D | 86 |
| crRNA 29 | CCACCCCAAUAUCGAAGGGGACUAAAACAACACAGGAAACAGCUAUGACCAUGAUU | 117D | 87 |
| crRNA 30 | CCACCCCAAUAUCGAAGGGGACUAAAACAAACACAGGAAACAGCUAUGACCAUGAU | 117D | 88 |
| crRNA 31 | CCACCCCAAUAUCGAAGGGGACUAAAACAUAAACACAGGAAACAGCUAUGACCAUG | 117D | 89 |
| crRNA 32 | CCACCCCAAUAUCGAAGGGGACUAAAACGGAUAAACACAGGAAACAGCUAUGACCA | 117D | 90 |
| crRNA 33 | CCACCCCAAUAUCGAAGGGGACUAAAACAGCGGAUAAACACAGGAAACAGCUAUGA | 117D | 91 |
| crRNA 34 | CCACCCCAAUAUCGAAGGGGACUAAAACGAGCGGAUAAACACAGGAAACAGCUAUG | 117D | 92 |
| Lsh_crRNA_DR_28 | CCACCCCAAUAUCGAAGGGGACUAAAACUAGAUUGCUGUUCUACCAAGUAAUCCAU | 120B | 93 |
| Lsh_crRNA_DR_26 | ACCCCAAUAUCGAAGGGGACUAAAACUAGAUUGCUGUUCUACCAAGUAAUCCAU | 120B | 94 |
| Lsh_crRNA_DR_24 | CCCAAUAUCGAAGGGGACUAAAACUAGAUUGCUGUUCUACCAAGUAAUCCAU | 120B | 95 |
| Lsh_crRNA_DR_22 | CAAUAUCGAAGGGGACUAAAACUAGAUUGCUGUUCUACCAAGUAAUCCAU | 120B | 96 |
| Lsh_crRNA_DR_20 | AUAUCGAAGGGGACUAAAACUAGAUUGCUGUUCUACCAAGUAAUCCAU | 120B | 97 |
| Lsh_crRNA_DR_19 | UAUCGAAGGGGACUAAAACUAGAUUGCUGUUCUACCAAGUAAUCCAU | 120B | 98 |
| Lsh_crRNA_DR_18 | AUCGAAGGGGACUAAAACUAGAUUGCUGUUCUACCAAGUAAUCCAU | 120B | 99 |
| Lsh_crRNA_24 | CCACCCCAAUAUCGAAGGGGACUAAAACUAGAUUGCUGUUCUACCAAGUAAU | 120A | 100 |
| Lsh_crRNA_23 | CCACCCCAAUAUCGAAGGGGACUAAAACUAGAUUGCUGUUCUACCAAGUAA | 120A | 101 |
| Lsh_crRNA_11 | CCACCCCAAUAUCGAAGGGGACUAAAACUAGAUUGCUGUUCUACCAAGUA | 120A | 102 |
| Lsh_crRNA_21 | CCACCCCAAUAUCGAAGGGGACUAAAACUAGAUUGCUGUUCUACCAAGU | 120A | 103 |

TABLE 10A-continued crRNA sequences used for in vitro experiments.

| Name | Sequence | 1st FIG. | SEQ ID NO: |
|---|---|---|---|
| Lsh_crRNA_20 | CCACCCCAAUAUCGAAGGGGACUAAAACUAGAUUGCUGUUCUACCAAG | 120A | 104 |
| Lsh_crRNA_19 | CCACCCCAAUAUCGAAGGGGACUAAAACUAGAUUGCUGUUCUACCAA | 120A | 105 |
| Lsh_crRNA_18 | CCACCCCAAUAUCGAAGGGGACUAAAACUAGAUUGCUGUUCUACCA | 120A | 106 |
| Lsh_crRNA_17 | CCACCCCAAUAUCGAAGGGGACUAAAACUAGAUUGCUGUUCUACC | 120A | 107 |
| Lsh_crRNA_16 | CCACCCCAAUAUCGAAGGGGACUAAAACUAGAUUGCUGUUCUAC | 120A | 108 |
| Lsh_crRNA_12 | CCACCCCAAUAUCGAAGGGGACUAAAACUAGAUUGCUGUU | 120A | 109 |
| Lsh_stem_1 | CCACCCGAAUAUCGAACGGGACUAAAACUAGAUUGCUGUUCUACCAAGUAAUCCAU | 121A | 110 |
| Lsh_stem_2 | CCACCGCAAUAUCGAAGCGGACUAAAACUAGAUUGCUGUUCUACCAAGUAAUCCAU | 121A | 111 |
| Lsh_stem_3 | CCACGCCAAUAUCGAAGGCGACUAAAACUAGAUUGCUGUUCUACCAAGUAAUCCAU | 121A | 112 |
| Lsh_stem_4 | CCAGCCCAAUAUCGAAGGGCACUAAAACUAGAUUGCUGUUCUACCAAGUAAUCCAU | 121A | 113 |
| Lsh_stem_5 | CCAGGGGAAUAUCGAACCCCACUAAAACUAGAUUGCUGUUCUACCAAGUAAUCCAU | 121A | 114 |
| Lsh_stem_6 | CCACCACCAAUAUCGAAGGGGACUAAAACUAGAUUGCUGUUCUACCAAGUAAUCCAU | 121A | 115 |
| Lsh_stem_7 | CCAACCCAAUAUCGAAGGGGACUAAAACUAGAUUGCUGUUCUACCAAGUAAUCCAU | 121A | 116 |
| Lsh_stem_8 | CCACCCAAUAUCGAAGGGGACUAAAACUAGAUUGCUGUUCUACCAAGUAAUCCAU | 121A | 117 |
| Lsh_stem_9 | CCACCCCCAAUAUCGAAGGGGGACUAAAACUAGAUUGCUGUUCUACCAAGUAAUCCAU | 121A | 118 |
| Lsh_loop_1 | CCACCCCAUAUCGAAGGGGACUAAAACUAGAUUGCUGUUCUACCAAGUAAUCCAU | 121B | 119 |
| Lsh_loop_2 | CCACCCCAUCGAAGGGGACUAAAACUAGAUUGCUGUUCUACCAAGUAAUCCAU | 121B | 120 |
| Lsh_loop_3 | CCACCCCAAGGGGACUAAAACUAGAUUGCUGUUCUACCAAGUAAUCCAU | 1219 | 121 |
| Lsh_loop_4 | CCACCCCAAAUAUCGAAGGGGACUAAAACUAGAUUGCUGUUCUACCAAGUAAUCCAU | 121B | 122 |
| Lsh_loop_5 | CCACCCCAAAAAUAUCGAAGGGGACUAAAACUAGAUUGCUGUUCUACCAAGUAAUCCAU | 121B | 123 |
| Lsh_loop_6 | CCACCCCAAAAAAAAAUAUCGAAGGGGACUAAAACUAGAUUGCUGUUCUACCAAGUAAUCCAU | 121B | 124 |
| Lsh_loop_7 | CCACCCCGAUAUCGAAGGGGACUAAAACUAGAUUGCUGUUCUACCAAGUAAUCCAU | 121B | 125 |
| Lsh_loop_8 | CCACCCCAAAAUCGAAGGGGACUAAAACUAGAUUGCUGUUCUACCAAGUAAUCCAU | 121B | 126 |
| Lsh_loop_9 | CCACCCCAAUAUCCAAGGGGACUAAAACUAGAUUGCUGUUCUACCAAGUAAUCCAU | 121B | 127 |
| Lsh_single_mismatch_pos1 | CCACCCCAAUAUCGAAGGGGACUAAAACAAGAUUGCUGUUCUACCAAGUAAUCCAU | 122C | 128 |
| Lsh_single_mismatch_pos5 | CCACCCCAAUAUCGAAGGGGACUAAAACUAGAAUGCUGUUCUACCAAGUAAUCCAU | 122C | 129 |

TABLE 10A-continued crRNA sequences used for in vitro experiments.

| Name | Sequence | 1st FIG. | SEQ ID NO: |
|---|---|---|---|
| Lsh_single_mismatch_pos9 | CCACCCCAAUAUCGAAGGGGACUAAAACUAGAUUGCAGUUCUACCAAGUAAUCCAU | 122C | 130 |
| Lsh_single_mismatch_pos13 | CCACCCCAAUAUCGAAGGGGACUAAAACUAGAUUGCUGUUGUACCAAGUAAUCCAU | 122C | 131 |
| Lsh_single_mismatch_pos17 | CCACCCCAAUAUCGAAGGGGACUAAAACUAGAUUGCUGUUCUACGAAGUAAUCCAU | 122C | 132 |
| Lsh_single_mismatch_pos21 | CCACCCCAAUAUCGAAGGGGACUAAAACUAGAUUGCUGUUCUACCAAGAAAUCCAU | 122C | 133 |
| Lsh_single_mismatch_pos25 | CCACCCCAAUAUCGAAGGGGACUAAAACUAGAUUGCUGUUCUACCAAGAAAUCCAU | 122C | 134 |
| Lsh_single_mismatch_pos28 | CCACCCCAAUAUCGAAGGGGACUAAAACUAGAUUGCUGUUCUACCAAGUAAUGCAU | 122C | 135 |
| Lsh_double_mismatch_pos1 | CCACCCCAAUAUCGAAGGGGACUAAAACUAGAUUGCUGUUCUACCAAGUAAUCCAA | 122C | 136 |
| Lsh_double_mismatch_pos6 | CCACCCCAAUAUCGAAGGGGACUAAAACUGAUUGCUGUUCUACCAAGUAAUCCAU | 122D | 137 |
| Lsh_double_mismatch_pos11 | CCACCCCAAUAUCGAAGGGGACUAAAACUAGUUGCUGAACUACCAAGUAAUCCAU | 122D | 138 |
| Lsh_double_mismatch_pos16 | CCACCCCAAUAUCGAAGGGGACUAAAACUAGAUUGCUGAACUACCAAGUAAUCCAU | 122D | 139 |
| Lsh_double_mismatch_pos21 | CCACCCCAAUAUCGAAGGGGACUAAAACUAGAUUGCUGUUCUAGGAAGUAAUCCAU | 122D | 140 |
| Lsh_double_mismatch_pos26 | CCACCCCAAUAUCGAAGGGGACUAAAACUAGAUUGCUGUUCUACCAAGUAAUCGUU | 122D | 141 |

TABLE 10B ssRNA targets used in this study.

| Name | Target | 1st FIG. | SEQ ID NO: |
|---|---|---|---|
| ssRNA 1 (C PAM) | GGCCAGUGAAUUCGAGCUCGGUACCCGGGGAUCCUCUAGAAAUAUGGAUUACUUGGUAGAACAGCAAUCUACUCGACCUGCAGGCAUGCAAGCUUGGCGUAAUCAUGGUCAUAGCUGUUUCCUGUGUUUAUCCGCUCACAAUUCCACACAACAUACGAGCCGGAAGCAUAAAG | 117B | 142 |
| ssRNA 2 | AAUAUGGAUUACUUGGUAGAACAGCAAUCUACAAAAAAAAAAAAAAAAAAAGAAAAAAAAAAAAAAAAAAAAAGAAAAAAAAAAAAAAAAAAAAAGAAAAAAAAAAAAAAAAAGAAAAAAAAAAAAAAAAAAAAAAGAAAAAAAAAAAAAAAAAAG | 118B | 143 |
| ssRNA 3 | AAUAUGGAUUACUUGGUAGAACAGCAAUCUACUUUUUUUUUUUUUUUUUUUCUUUUUUUUUUUUUUUUUUCUUUUUUUUUUUUUUUUUUUCUUUUUUUUUUUUUUUUUUUUCUUUUUUUUUUUUUUUUUUUUUCUUUUUUUUUUUUUUUUUUUUC | 118B | 144 |
| ssRNA 4 | GGGUAGGUGUUCCACAGGGUAGCCAGCAGCAUCCUGCGAUGCAAAUAUGGAUUACUUGGUAGAACAGCAAUCUAAUCCGGAACAUAAUGGUGCAGGGCGCUGACUUCCGCGUUUCCAGACUUUACGAAACACGGAAACCGAAGACCAUUCAUGUUGUUGCUGCCGGAAGCAUAAAG | 118C | 145 |
| ssRNA 5 | GGGCCCCUCCGUUCGCGUUUACGCGGACGGUGAGACUGAAGAUAAUAUGGAUUACUUGGUAGAACAGCAAUCUAAACUCAUUCUCUUUAAAAUAUCGUUCGAACUGGACUCCCCGGUCGUUUUAACUCGACUGGGGCCAAAACGAAACAGUGGCACUACCCCGCCGGAAGCAUAAAG | 118C | 146 |
| ssRNA 1 (G PAM) | GGCCAGUGAAUUCGAGCUCGGUACCCGGGGAUCCUCUAGAAAUAUGGAUUACUUGGUAGAACAGCAAUCUAGUCGACCUGCAGGCAUGCAAGCU | 117C | 147 |

TABLE 10B-continued ssRNA targets used in this study.

| Name | Target | 1st FIG. | SEQ ID NO: |
|---|---|---|---|
| | UGGCGUAAUCAUGGUCAUAGCUGUUUCCUGUGUUUAUCCGCUCACAA UUCCACACAACAUACGAGCCGGAAGCAUAAAG | | |
| ssRNA 1 (A PAM) | GGCCAGUGAAUUCGAGCUCGGUACCCGGGGAUCCUCUAGAAAUAUGG AUUACUUGGUAGAACAGCAAUCUAAUCGACCUGCAGGCAUGCAAGCU UGGCUGAAUCAUGGUCAUAGCUGUUUCCUGUGUUUAUCCGCUCACAA UUCCACACAACAUACGAGCCGGAAGCAUAAAG | 117C | 148 |
| ssRNA 1 (U PAM) | GGCCAGUGAAUUCGAGCUCGGUACCCGGGGAUCCUCUAGAAAUAUGG AUUACUUGGUAGAACAGCAAUCUAUUCGACCUGCAGGCAUGCAAGCU UGGCUGAAUCAUGGUCAUAGCUGUUUCCUGUGUUUAUCCGCUCACAA UUCCACACAACAUACGAGCCGGAAGCAUAAAG | 117C | 149 |
| ssRNA 6 | ACCGAUCGUCGUUGUUUGGGCAAUGCACGUUCUCCAACGGUGCUCCUA UGGGGCACAAGUUGCAGGAUGCAGCGCCUUACAAGAAGUUCGCUGAA CAAGCAACCGUUACCCCCCGCGCUCUGAGAGCGGCUCUAUUGGUCCGA GACCAAUGUGCGCCGUGGAUCAGACACGCGGU | 124B | 150 |
| ssRNA 7 | ACUGUUGGUGGUGUAGAGCUUCCUGUAGCCGCAUGGCGUUCGUACUU AAAUAUGGAACUAACCAUUCCAAUUUUCGCUACGAAUUCCGACUGCGA GCUUAUUGUUAAGGCAAUGCAAGGUCUCCUAAAAGAUGGAAACCCGA UUCCCUCAGCAAUCGCAGCAAACUCCGGCAUCU | 124B | 151 |
| ssRNA 8 | GGUAACAUGCUCGAGGGCCUUACGGCCCCCGUGGGAUGCUCCUACAUG UCAGGAACAGUUACUGACGUAAUAACGGGUGAGUCCAUCAUAAGCGU UGACGCUCCCUACGGGUGGACUGUGGAGAGACAGGGCACUGCUAAGGC CCAAAUCUCAGCCAUGCAUCGAGGGGUACAAU | 124B | 152 |
| ssRNA 9 | UUCGUAAAACGUUCGUGUCCGGGCUCUUUCGCGAGAGCUGCGGCGCGC ACUUUUACCGUGGUGUCGAUGUCAAACCGUUUUACAUCAAGAAACCU GUUGACAAUCUCUUCGCCCUGAUGCUGAUAUUAAUCGGCUACGGGG UUGGGGAGUUGUCGGAGGUAUGUCAGAUCCACG | 124B | 153 |
| ssRNA 10 | AUAGGCCAGUGAAUUCGAGCUCGAAUAUGGAUUACUUGGUAGAACAG CAAUCUACGCCGGAAGCAUAAAG | 119D | 154 |
| ssRNA 10 (rc) | CUUUAUGCUUCCGGCGUAGAUUGCUGUUCUACCAAGUAAUCCAUAUUC GAGCUCGAAUUCACUGGCCUAU | 119D | 155 |
| ssDNA target | ctttatgcttccggctcgtatgttgtgtggaattgtgagcggataaaca caggaaacagctatgaccatgattacgccaagcttgcatgcctgcaggt cgagaatatggattacttggtagaacagcaatctactagaggatcccg ggtaccgagctcgaattcactggccccctatagtgagtcgtattaatttc | 134D | 156 |

TABLE 10C

Spacers used for in vivo experiments.

| Name | Sequence | 1st FIG. | SEQ ID NO: |
|---|---|---|---|
| spacer 1 | GAAGUUUGCAGCUGGAUACGACAGACGG | 1116D | 157 |
| spacer 2 | UGUCUGGAAGUUUGCAGCUGGAUACGAC | 1116D | 158 |
| spacer 3 | AGCUGGAUACGACAGACGGCCAUCUAAC | 1116D | 159 |
| spacer 4 | UACGUCGCGAUAUGUUGCACGUUGUCUG | 1116D | 160 |
| spacer 5 | UACGGACGACCUUCACCUUCACCUUCGAUUU | 123A | 161 |
| spacer 6 | UCGUACGGACGACCUUCACCUUCACCUUCGA | 123A | 162 |
| spacer 7 | CGGUCUGGGUACCUUCGUACGGACGACCUUC | 123A | 163 |
| spacer 8 | GCGGUCUGGGUACCUUCGUACGGACGACCUU | 123A | 164 |
| spacer 9 | AGCGGUCUGGGUACCUUCGUACGGACGACCU | 123A | 165 |
| spacer 10 | AGUUCAUAACACGUUCCCAUUUGAAACCUUC | 123A | 166 |

TABLE 10C-continued

Spacers used for in vivo experiments.

| Name | Sequence | 1st FIG. | SEQ ID NO: |
|---|---|---|---|
| spacer 11 | UUAACUUUGUAGAUGAACUCACCGUCUUGCA | 123A | 167 |
| spacer 12 | UUUAACUUUGUAGAUGAACUCACCGUCUUGC | 123A | 168 |
| spacer 13 | GUUUAACUUUGUAGAUGAACUCACCGUCUUG | 123A | 169 |
| spacer 35 | AAGUUUGCAGCUGGAUACGACAGACGGC | 119B | 170 |
| spacer 36 | ACAGGAUGUCCCAAGCGAACGGCAGCGG | 139 | 171 |
| spacer 37 | GCUUGUUCAGCGAACUUCUUGUAAGGCG | 129A | 172 |
| spacer 38 | UAAGCUCGCAGUCGGAAUUCGUAGCGAA | 129A | 173 |
| spacer 39 | CUICAACGCUBAUGAUGGACUCACCCGU | 129A | 174 |
| spacer 40 | UCAACAGGUUUCUUGAUGUAAAACGGUU | 129A | 175 |
| spacer 41 | AAGUUUGCAGCUGGAUACGACAGACGGC | 130 | 176 |
| spacer 42 | UUUGCAGCUGGAUACGACAGACGGCCAU | 130 | 177 |
| spacer 43 | CAGCUGGAUACGACAGACGGCCAUCUAA | 130 | 178 |
| spacer 44 | GUUGUCUGGAAGUUUGCAGCUGGAUACG | 130 | 179 |
| spacer 45 | GCGAUAUGUUGCACGUUGUCUGGAAGUU | 130 | 180 |
| spacer 46 | ACGUUGUCUGGAAGUUUGCAGCUGGAUA | 130 | 181 |
| spacer 47 | AUGUUGCACCUUGUCUGGAAGUUUCCAG | 130 | 182 |
| spacer 48 | UGCAGCUGGAUACGACAGACGGCCAUCU | 130 | 183 |
| spacer 49 | CUGGAAGUUUGCAGCUGGAUACGACAGA | 130 | 184 |
| spacer 50 | AGUUUGCAGCUGGAUACGACAGACGGCC | 130 | 185 |
| spacer 51 | GCUGGAUACGACAGACGGCCAUCUAACU | 130 | 186 |
| spacer 52 | GUUUGCAGCUGGAUACGACAGACGGCCA | 130 | 187 |
| spacer_41_single_mismatch_pos1 | UAGUUUGCAGCUGGAUACGACAGACGGC | 122A | 188 |
| spacer_41_single_mismatch_pos5 | AAGUAUGCAGCUGGAUACGACAGACGGC | 122A | 189 |
| spacer_41_single_mismatch_pos9 | AAGUUUGCUGCUGGAUACGACAGACGGC | 122A | 190 |
| spacer_41_single_mismatch_pos13 | AAGUUUGCAGCUCGAUACGACAGACGGC | 122A | 191 |
| spacer_41_single_mismatch_pos17 | AAGUUUGCAGCUGGAUUCGACAGACGGC | 122A | 192 |
| spacer_41_single_mismatch_pos21 | AAGUUUGCAGCUGGAUACGAGAGACGGC | 122A | 193 |
| spacer_41_single_mismatch_pos25 | AAGUUUGCAGCUGGAUACGACAGAGGGC | 122A | 194 |
| spacer_41_double_mismatch_pos1 | UUGUUUGCAGCUGGAUACGACAGACGGC | 122A | 195 |

TABLE 10C-continued

Spacers used for in vivo experiments.

| Name | Sequence | 1st FIG. | SEQ ID NO: |
|---|---|---|---|
| spacer_41_double_mismatch_pos6 | AAGUUACCAGCUGGAUACGACAGACGGC | 122A | 196 |
| spacer_41_double_mismatch_pos11 | AAGUUUGCAGGAGGAUACGACAGACGGC | 122A | 197 |
| spacer_41_double_mismatch_pos16 | AAGUUUGCAGCUGGAAUCGACAGACGGC | 122A | 198 |
| spacer_41_double_mismatch_pos21 | AAGUUUGCAGCUGGAUACGAGUGACGGC | 122A | 199 |

Figure 116A:
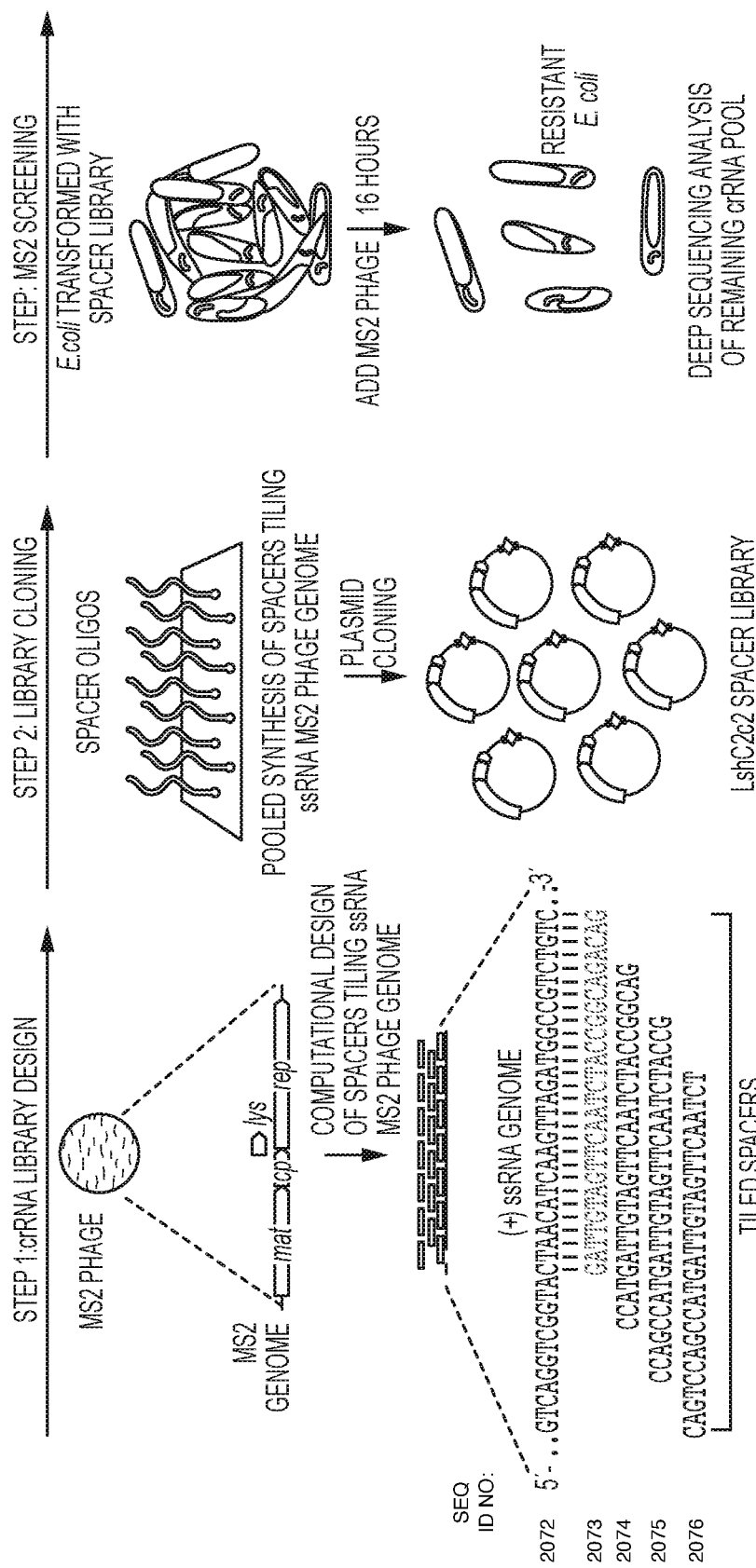
Figure 116C:
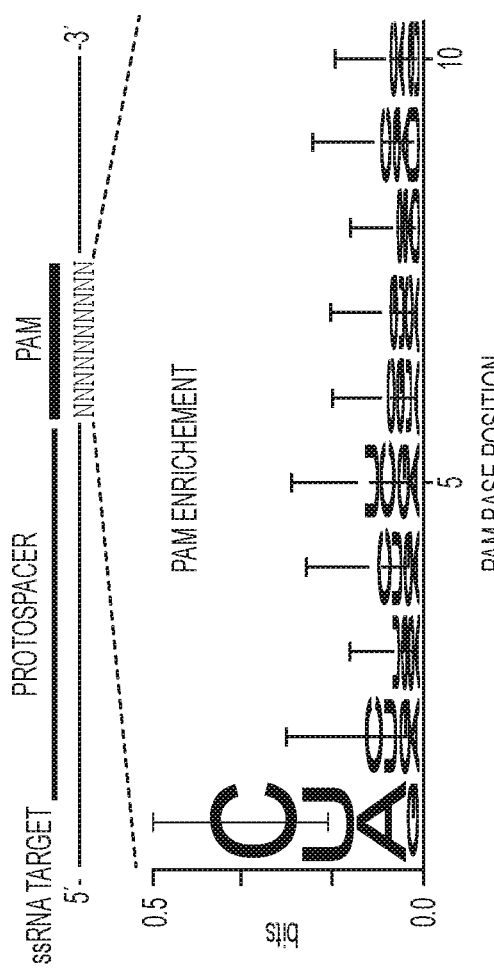
Figure 116B:
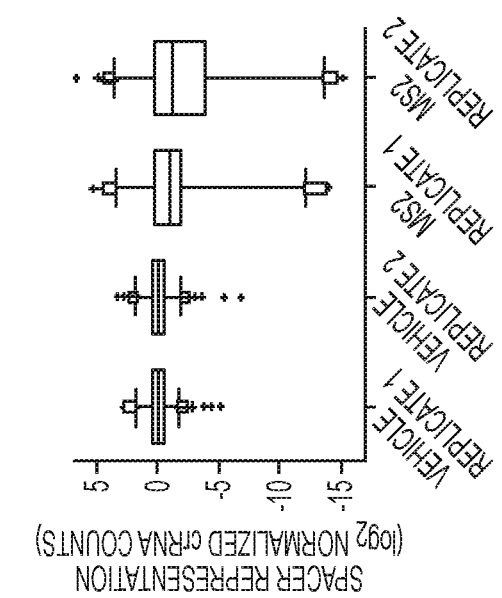

Heterologous Reconstitution of the L. shahii C2c2 Locus in Escherichia coli Confers RNA-Guided Immunity Against a RNA Bacteriophage As a first step, we explored whether LshC2c2 could be used to confer immunity to MS2 (G. Tamulaitis et al., Programmable RNA shredding by the type II-A CRISPR-Cas system of Streptococcus thermophilus. Mol Cell 56, 506-517 (2014)), a lytic single-stranded (ss) RNA phage without DNA intermediates in its life cycle that readily infects E. coli. We constructed allow-copy plasmid carrying the entire LshC2c2 locus (pLshC2c2) to allow for heterologous reconstitution in E. coli (FIG. 126). Given that expressed mature crRNAs from the LshC2c2 locus have a maximum spacer length of 28 nt (FIG. 126) (S. Shmakov et al., Discovery and Functional Characterization of Diverse Class 2 CRISPR-Cas Systems. Mol Cell 60, 385-397 (2015)), we synthesized a library of 3,473 spacer sequences tiling all possible 28-nt target sites in the MS2 phage genome and cloned them as spacers into the pLshC2c2 CRISPR array. After transformation in E. coli, cells were infected with MS2 and spacer sequences in cells that survived the infection were determined. Cells carrying spacers that confer robust interference against MS2 will proliferate more rapidly, leading to enrichment of these spacers following growth for 16 hours. A number of spacers were consistently enriched across two independent replicas, suggesting that they enabled strong interference against MS2 (107 spacers showed >1.3 log 2-fold enrichment in both replicas; FIG. 116B and FIG. 127A-127B). By analyzing the flanking regions of protospacer on the MS2 genome corresponding to the 107 enriched spacers, we found that spacers with G immediately adjacent to the 3' end of the protospacer performed more poorly than those with an H (i.e. A, U, or C), indicating a single nucleotide PAM, H (FIG. 116C and FIG. 127C-127D, FIG. 128A-128G).

To validate the interference activity of enriched spacers, we individually cloned four top-enriched spacers into pLshC2c2 CRISPR arrays and observed a 3- to 4-log reduction in plaque formation, consistent with the level of enrichment observed in the screen (FIG. 116B and FIG. 129A-129B). To confirm the PAM, we cloned sixteen guides targeting distinct regions of the MS2 mat gene (4 guides per possible single-nucleotide PAM). We found that all 16 crRNAs mediated MS2 interference, although higher levels of resistance were observed for the C, A, and U PAM-targeting guides (FIGS. 116D, 116E and FIG. 130-1-130-2), indicating that C2c2 can be effectively retargeted in a crRNA-dependent fashion to sites within the MS2 genome.

C2c2 is a Single-Effector endoRNase that Mediates ssRNA Cleavage with a Single crRNA Guide To test whether LshC2c2 mediated phage interference by facilitating crRNA-guided ssRNA cleavage, we purified the LshC2c2 protein (FIG. 131A-131D) and assayed its ability to cleave an in vitro transcribed 173-nt ssRNA target (FIG. 117A and FIG. 132A-132B) containing a C PAM protospacer (ssRNA target 1 with protospacer 14). Previously, we found that mature LshC2c2 crRNAs contain a 28-nt direct repeat (DR) and a 28 nt spacer (FIG. 126) (S. Shmakov et al., Discovery and Functional Characterization of Diverse Class 2 CRISPR-Cas Systems. Mol Cell 60, 385-397 (2015)), and we therefore generated an in-vitro-transcribed crRNA with 28-nt spacer complementary to protospacer 14 on ssRNA target 1. We found that LshC2c2 efficiently cleaved ssRNA in a Mg2+- and crRNA-dependent manner (FIG. 117B and FIG. 133). To investigate cleavage of dsRNA substrates, we annealed complementary RNA oligos to regions flanking the crRNA target site. This partially double-stranded RNA substrate was not cleaved by LshC2c2, indicating it is specific for ssRNA (FIGS. 134A-134B).

Figure 117D:
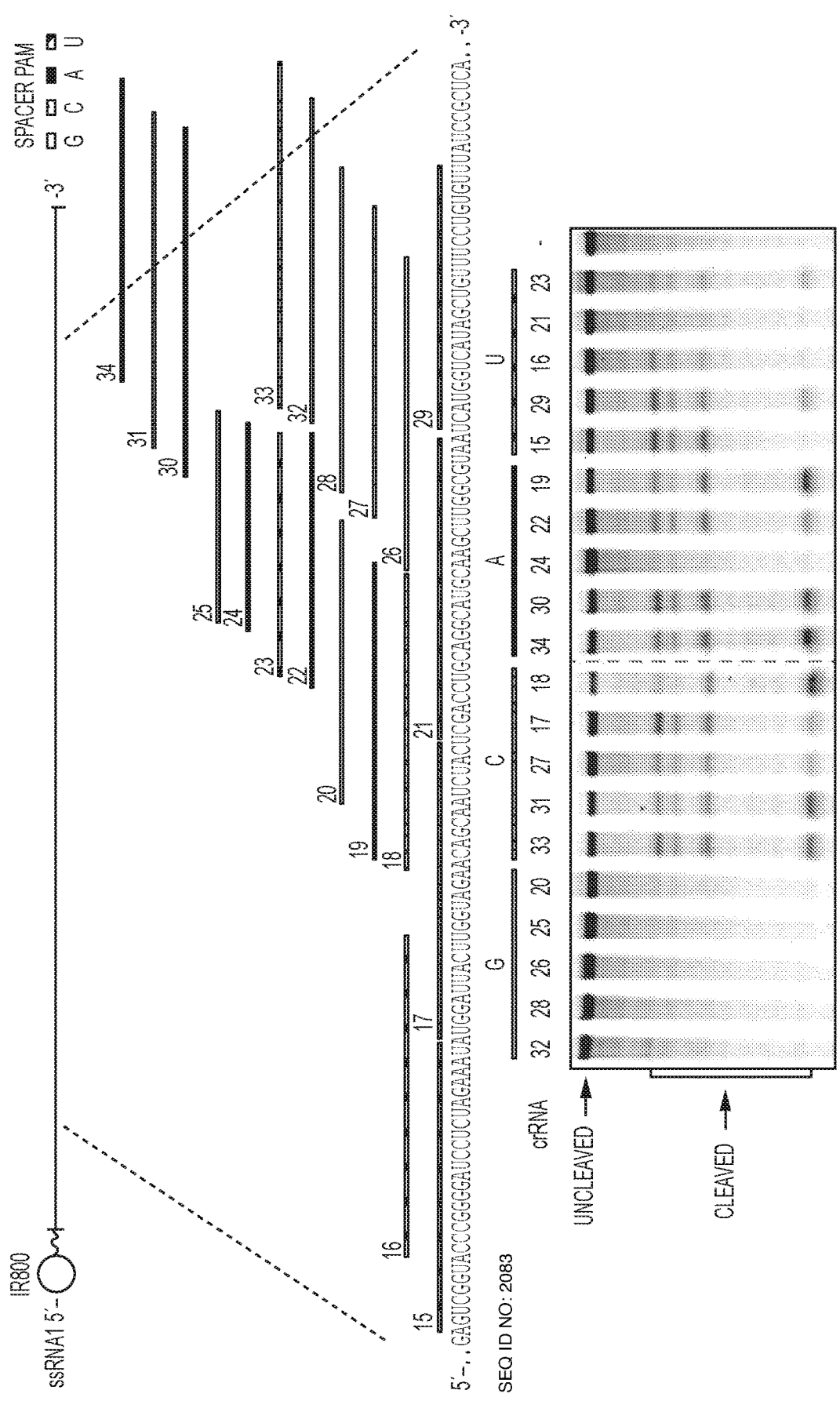

To further characterize the sequence constraints of RNA cleavage by LshC2c2, we tested additional crRNAs complementary to different versions of ssRNA target 1 where protospacer 14 is preceded by each PAM variant. The results of this experiment confirmed the preference for C, A, and U PAMs, with little cleavage activity detected for the G PAM target (FIG. 117C). Additionally, we designed 5 crRNAs for each possible PAM (20 total) across ssRNA target 1 and evaluated cleavage activity for LshC2c2 paired with each of these crRNAs. As expected, we found less cleavage activity for G PAM-targeting crRNAs compared to other crRNAs tested (FIG. 117D).

LshC2c2 was tested for DNA cleavage activity in vitro. We generated a dsDNA plasmid library with protospacer 14 preceded by 7 random nucleotides to account for any PAM requirements. When incubated with LshC2c2 protein and a crRNA complementary to protospacer 14, no cleavage of the dsDNA plasmid library was observed (FIG. 134C). We also did not observe cleavage when targeting a ssDNA version of ssRNA target 1 (FIG. 134D). To rule out co-transcriptional DNA cleavage which has been observed in type III CRISPR-Cas systems (P. Samai et al., Co-transcriptional DNA and RNA Cleavage during Type III CRISPR-Cas Immunity. Cell 161, 1164-1174 (2015)), we recapitulated the *E. coli* RNA polymerase co-transcriptional cleavage assay (P. Samai et al., Co-transcriptional DNA and RNA Cleavage during Type III CRISPR-Cas Immunity. Cell 161, 1164-1174 (2015)) (FIG. 135A), expressing ssRNA target 1 from a DNA substrate. Using this assay with the purified LshC2c2 and crRNA targeting ssRNA target 1, we still did not observe any DNA cleavage (FIG. 135B). Together, these results indicate that C2c2 cleaves specific ssRNA sites directed by the target complementarity encoded in the crRNA, with a 3' H PAM requirement.

C2c2 Cleavage Depends on Local Target Sequence and Secondary Structure

Given that C2c2 did not efficiently cleave dsRNA substrates and that ssRNA forms complex secondary structures, we reasoned that cleavage by C2c2 might be affected by secondary structure of the ssRNA target. In tiling ssRNA target 1 with different crRNAs (FIG. 117D), the same cleavage pattern was observed regardless of the crRNA position along the target RNA, suggesting that the crRNA-dependent cleavage pattern was determined by some features of the target sequence rather than the distance from the binding site. We hypothesized that the LshC2c2-crRNA complex binds the target and cleaves exposed regions of ssRNA within the secondary structure elements, with a potential preference for certain nucleotides. We analyzed the cleavage efficiencies of homopolymer RNA targets (a 28-nt protospacer extended with 120 As or Us regularly interspaced by single bases of G or C to enable oligo synthesis) and found that LshC2c2 preferentially cleaved the uracil target compared to adenine (FIG. 118A-118B). To assess the impact of the target RNA on the cleavage pattern, we tested cleavage of three ssRNA targets with different sequences flanking a constant 28-nt protospacer and found three distinct patterns of cleavage (FIG. 118C). RNA-sequencing of the cleavage products for the three targets revealed that cleavage sites mainly localized to uracil-rich regions of ssRNA or ssRNA-dsRNA junctions within the in silico predicted co-folds of the target sequence with the crRNA (FIG. 118D-118I).

The HEPN Domains of C2c2 Mediate RNA-Guided ssRNA-Cleavage

Previous bioinformatics analysis of C2c2 suggested that the HEPN domains are potentially responsible for the catalytic activity we observed (S. Shmakov et al., Discovery and Functional Characterization of Diverse Class 2 CRISPR-Cas Systems. Mol Cell 60, 385-397 (2015)). Each of the two HEPN domains of C2c2 contains a dyad of conserved arginine and histidine residues (FIG. 119A), in agreement with the catalytic mechanism of the HEPN endoRNAse (V. Anantharaman, K. S. Makarova, A. M. Burroughs, E. V. Koonin, L. Aravind, Comprehensive analysis of the HEPN superfamily: identification of novel roles in intra-genomic conflicts, defense, pathogenesis and RNA processing. Biol Direct 8, 15 (2013); O. Niewoehner, M. Jinek, Structural basis for the endoribonuclease activity of the type III-A CRISPR-associated protein Csm6. RNA 22, 318-329 (2016); N. F. Sheppard, C. V. Glover, 3rd, R M. Terns, M. P. Terns, The CRISPR-associated Csx1 protein of *Pyrococcus furiosus* is an adenosine-specific endoribonuclease. RNA 22, 216-224 (2016)). To test whether these predicted catalytic residues were required for ssRNA depletion in vivo, we mutated each residue separately to alanine (R597A, H602A, R1278A, H1283A) in the LshC2c2 locus plasmids and assayed for MS2 interference. None of the four mutant plasmids were able to protect *E. coli* from phage infection (FIG. 119B and FIG. 136).

In order to validate these findings in vitro, the four single-point mutant proteins were purified and assayed their ability to cleave 5'-end-labeled ssRNA target 1 (FIG. 119C). In agreement with our in vivo results, all four mutations abolished cleavage activity. The inability of either of the two wild-type HEPN domains to compensate for inactivation of the other implies cooperation between the two domains, which agrees with observations that several bacterial and eukaryotic single-HEPN proteins function as dimers (O. Niewoehner, M. Jinek, Structural basis for the endoribonuclease activity of the type III-A CRISPR-associated protein Csm6. RNA 22, 318-329 (2016); N. F. Sheppard, C. V. Glover, 3rd, R. M. Terns, M. P. Terns, The CRISPR-associated Csx1 protein of *Pyrococcus furiosus* is an adenosine-specific endoribonuclease. RNA 22, 216-224 (2016); G. Kozlov et al., Structural Basis of Defects in the Sacsin HEPN Domain Responsible for Autosomal Recessive Spastic Ataxia of Charlevoix-Saguenay (ARSACS). J Biol Chem 286, 20407-20412 (2011)).

Catalytically inactive variants of Cas9 retain target DNA binding, allowing for the creation of programmable DNA-binding proteins (G. Gasiunas, R. Barrangou, P. Horvath, V. Siksnys, Cas9-crRNA ribonucleoprotein complex mediates specific DNA cleavage for adaptive immunity in bacteria. Proc Natl Acad Sci USA 109, E2579-2586 (2012); M. Jinek et al., A programmable dual-RNA-guided DNA endonuclease in adaptive bacterial immunity. Science 337, 816-821 (2012)). To determine if target binding and cleavage activity of LshC2c2 are likewise separable, electrophoretic mobility shift assays (EMSA) were performed on both the wild-type (FIG. 119D) and R1278A mutant LshC2c2 (FIG. 119E) in complex with crRNA. The wild-type LshC2c2 complex bound strongly (KD~46 nM, FIG. 137A) and specifically to ssRNA target 10, but not to the non-target ssRNA (the reverse complement of ssRNA target 10). The R1278A mutant C2c2 complex showed an even stronger (KD~7 nM, FIG. 137B) specific binding, indicating that this HEPN mutation results in a catalytically inactive, RNA-programmable RNA-binding protein. The LshC2c2 protein or crRNA alone showed substantially reduced levels of target affinity as expected (FIG. 137C-137E).

These results demonstrate that C2c2 cleaves RNA using a catalytic mechanism distinct from other known CRISPR-associated RNases. In particular, the type III Csm and Cmr multiprotein complexes rely on acidic residues of RRM domains for catalysis, whereas C2c2 achieves RNA cleavage through conserved basic residues of its two HEPN domains.

Sequence and Structural Requirements of C2c2 crRNA

Similar to the type V-B (Cpf1) systems (B. Zetsche et al., Cpf1 is a single RNA-guided endonuclease of a class 2 CRISPR-Cas system. Cell 163, 759-771 (2015)), the LshC2c2 crRNA contains a single stem loop in the direct repeat (DR), suggesting that the secondary structure of the crRNA could facilitate interaction with LshC2c2. To explore this possibility, we first investigated the length requirements of the spacer sequence for ssRNA cleavage and found that LshC2c2 requires spacers of at least 22 nt length to efficiently cleave ssRNA target 1 (FIG. 120A). We also found that the stem-loop structure of the crRNA is critical for ssRNA cleavage because DR truncations that disturbed the stem loop abrogated target cleavage (FIG. 120B). Thus, a DR longer than 24 nt is required to maintain the stem loop necessary for LshC2c2 to mediate ssRNA cleavage.

Next, we studied the effects of modifications in the stem and loop of the crRNA DR on the cleavage activity. Single basepair inversions in the stem that preserved the stem structure did not affect the activity of the LshC2c2 complex but inverting all four G-C pairs in the stem eliminated the cleavage despite maintaining the duplex structure (FIG. 121A). Other perturbations that introduced kinks and reduced or increased base-pairing in the stem also eliminated or significantly suppressed cleavage, suggesting that the crRNA stem length is important for complex formation and activity (FIG. 121A). Through a series of modifications, we found that loop deletions eliminated cleavage, whereas insertions and substitutions mostly maintained some level of cleavage activity (FIG. 121B). Together, these results demonstrate that LshC2c2 recognizes structural characteristics of its cognate crRNA but is amenable to loop insertions and most tested base substitutions. These results have implications for the future application of C2c2-based tools that require guide engineering for recruitment of effectors or modulation of activity (S. Kiani et al., Cas9 gRNA engineering for genome editing, activation and repression. Nat Methods 12, 1051-1054 (2015); S. Konermann et al., Genome-scale transcriptional activation by an engineered CRISPR-Cas9 complex. Nature 517, 583-588 (2015); J. E. Dahlman et al., Orthogonal gene knockout and activation with a catalytically active Cas9 nuclease. Nat Biotechnol 33, 1159-1161 (2015)).

C2c2 Cleavage is Sensitive to Double Mismatches in the crRNA-Target Duplex

We tested the sensitivity of the LshC2c2 system to single mismatches between the crRNA guide and target RNA by mutating single bases across the spacer to the respective complementary bases (e.g., A to U) and quantified plaque formation with these mismatched spacers in the MS2 infection assay (FIG. 122A and FIG. 138). We found that C2c2 was fully tolerant to single mismatches across the spacer as such mismatched spacers interfered with phage propagation with similar efficiency as fully matched spacers. However, when we introduced consecutive double substitutions in the spacer, we found ~3 log-fold reduction in the protection for mismatches in the center, but not at the 5'- or 3'-end, of the crRNA (FIG. 122B and FIG. 138). This observation indicates the presence of a mismatch-sensitive "seed region" in the center of the crRNA-target duplex.

We further evaluated the requirements of LshC2c2 for the guide and target to match in vitro. To this end, we generated a set of in vitro transcribed crRNAs with mismatches similarly positioned across the spacer region. When incubated with LshC2c2 protein, all single mismatched crRNA supported cleavage (FIG. 122C), in agreement with our in vivo findings. When tested with a set of consecutive double mutant crRNAs, LshC2c2 was unable to cleave the target RNA if the mismatches were positioned in the center, but not at the 5'- or 3'-end of the crRNA (FIG. 122D), supporting the existence of a core seed region.

Sensitivity of the LshC2c2 system to double and triple mismatches was also evaluated. Double mismatches were spaced apart (FIG. 143A) whereas triple mismatches were consecutive (FIG. 143B). Cleavage sensitivity was position dependent. Mismatches proximal to the DR region did not support cleavage whereas distal mismatches supported detectable cleavage.

The LshC2c2 system is also sensitive to mismatches and deletions in the direct repeat region. Single mismatches and single base deletions were generally sufficient to disrupt ssRNA cleavage. Only one mismatch (mutant 7) supported a low level of cleavage activity (FIG. 144).

C2c2 can be Reprogrammed to Mediate Specific mRNA Knockdown In Vivo

Given the ability of C2c2 to cleave target ssRNA in a crRNA sequence-specific manner, we tested whether LshC2c2 can be reprogrammed to degrade selected non-phage ssRNA targets, and particularly mRNAs, in vivo. To this end, we co-transformed E. coli with a plasmid encoding LshC2c2 and a crRNA targeting the mRNA of red fluorescent protein (RFP) as well as a compatible plasmid expressing RFP (FIG. 123A). We observed an approximately 20% to 92% decrease in RFP positive cells for crRNAs targeting protospacers flanked by C, A, or U PAMs for OD-matched samples (FIG. 123B, 123C). As a control, we tested crRNAs containing reverse complements (targeting the dsDNA plasmid) of the top performing RFP mRNA-targeting spacers. As expected, we observed no decrease in RFP fluorescence by these crRNAs (FIG. 123B). We also confirmed that mutation of the catalytic arginine residues in either HEPN domain to alanine precluded RFP knockdown (FIG. 139). Thus, C2c2 is capable of general retargeting to arbitrary ssRNA substrates, governed exclusively by predictable nucleic-acid interactions.

When we examined the growth rate of cells carrying the RFP-targeting spacer with the greatest level of RFP knockdown, we noted that the rate was significantly reduced (FIG. 123A, spacer 7). To determine the cause for this growth restriction, we investigated whether the effect on growth was mediated by the RFP mRNA-targeting activity of LshC2c2 by introducing an inducible-RFP plasmid and an RFP-targeting LshC2c2 locus into E. coli. Using this system, we found that upon induction of RFP transcription, cells with RFP knockdown showed substantial growth suppression, which was not observed in non-targeting controls (FIG. 123D, 123E). However, in the absence of RFP transcription, we did not observe any growth restriction nor did we observe any transcription-dependent DNA targeting in our biochemical experiment (FIG. 135A-135B), which suggests that RNA-targeting is likely the primary driver of this growth restriction phenotype. Without wishing to be bound by theory, one possible explanation for this effect is that C2c2 CRISPR systems might function to prevent virus reproduction by indiscriminately cleaving cellular mRNAs and causing reduced cell division, programmed cell death (PCD) or dormancy (K. S. Makarova, Y. I. Wolf, E. V. Koonin, Comprehensive comparative-genomic analysis of type 2 toxin-antitoxin systems and related mobile stress response systems in prokaryotes. Biol Direct 4, 19 (2009); F. Hayes, L. Van Melderen, Toxins-antitoxins: diversity, evolution and function. Crit Rev Biochem Mol Biol 46, 386-408 (2011)).

C2c2 Cleaves Collateral RNA in Addition to crRNA-Targeted ssRNA

In contrast to Cas9 and Cpf1, which cleave DNA within the crRNA-target heteroduplex at a defined position, reverting into an inactive state after cleavage, C2c2 cleaves the target RNA outside of the crRNA binding site at varying distances depending on flanking sequence, presumably within exposed ssRNA loop regions (FIG. 118D-118I). This observed flexibility in cleavage distance lead us to consider the possibility of cleavage of nearby non-target ssRNAs upon C2C2 target binding and activation. Accordingly, C2c2 could cause PCD through a two-part mechanism: a priming stage in which C2c2-crRNA complexes bind to target sites and cleave ssRNA in a crRNA-guided fashion and a second stage in which primed C2c2 cleaves non-targeted, collateral RNA non-specifically. To test this hypothesis, we carried out in vitro cleavage reactions that included, in addition to LshC2c2, crRNA and its target RNA, one of four unrelated RNA molecules without any complementarity to the crRNA guide (FIG. 124A). These experiments showed that, whereas the LshC2c2-crRNA complex did not mediate cleavage of any of the four collateral RNAs in the absence of the target RNA, all four were efficiently degraded in the presence of the target RNA (FIG. 124B and FIG. 140A). Furthermore, R597A and R1278A HEPN mutants were unable to cleave collateral RNA (FIG. 140B). These results indicate a HEPN-dependent mechanism whereby C2c2 in a complex with crRNA is activated upon binding to target RNA and subsequently cleaves any nearby ssRNA targets. Such promiscuous RNA cleavage may cause cellular toxicity, resulting in the observed growth rate inhibition. These findings imply that, in addition to their role in direct suppression of RNA viruses, type VI CRISPR-Cas systems could function as mediators of a distinct variety of PCD/dormancy induction that is specifically triggered by the cognate invader genomes (FIG. 125). Under this scenario, dormancy would slow the infection and supply additional time for adaptive immunity to succeed; when adaptive immunity fails, the suicidal role of C2c2 would prevail and spread of the infection would be limited. Such a mechanism falls within the previously proposed scheme of coupling between adaptive immunity and PCD during the CRISPR-Cas defensive response (K. S. Makarova, V. Anantharaman, L. Aravind, E. V. Koonin, Live virus-free or die: coupling of antivirus immunity and programmed suicide or dormancy in prokaryotes. Biol Direct 7, 40 (2012)).

Example 8: Expression of C2c2 in Eukaryotic Cells

A number of C2c2 orthologues were codon optimized for expression in mammalian cells using a mammalian expression vector. The various C2c2 orthologues were transfected in HEK293T cells and cellular localization was evaluated based on mCerry expression. Cytoplasmic localization as well as nuclear localization of the C2c2 protein was observed.

Example 9: Activity of C2c2 in Eukaryotic Cells

A luciferase targeting assay was performed with different gRNAs directed against the C2c2 protein. Efficient knockdown was observed.

A targeting assay based on GFP expression was performed with gRNAs directed against EGFP. Expression of GFP was determined and compared to non-targeting (NT) gRNA. Here too efficient knockdown was observed.

A targeting assay was performed on different endogenous target genes in HEK293 cells with gRNAs directed against endogenous target genes. C2c2. Expression protein expression of the respective target genes was determined (compared to non-targeting (NT) gRNA). Efficient knockdown of the different target genes was observed.

Methodology for the Examples
Cloning of C2c2 Locus and Screening Library

Genomic DNA from *Leptotrichia shahii* DSM 19757 (ATCC) was extracted using the Blood & Cell Culture DNA Mini Kit (Qiagen) and the C2c2 CRISPR locus was PCR amplified and cloned into a pACYC184 backbone with chloramphenicol resistance. For retargeting of the locus to MS2 phage or endogenous targets, the wild type spacers in the array were removed and replaced with a Eco31I landing site an additional spacer and a degenerate repeat, compatible with Golden Gate cloning.

A custom library consisting of all possible spacers targeting the genome of the bacteriophage MS2, excluding spacers containing the Eco31I restriction site, was synthesized by Twist Biosciences, cloned into the retargeting backbone with Golden Gate cloning, transformed into Endura Duo electrocompetent cells (Lucigen) and subsequently purified using a NucleoBond Xtra MaxiPrep EF (Machery-Nagel).

Bacterial Interference Assay

For the phage screen, 50 ng of the plasmid library were transformed into NovaBlue (DE3) Competent Cells (EMD Millipore) followed by an outgrowth at 37° C. for 30 minutes. Cells were then grown in Luria broth (LB) supplemented with 25 µg/mL chloramphenicol (Sigma) in a volume of 4.5 mL. Phage conditions were treated with $7*10$ PFU of Bacteriophage MS2 (ATCC). After 3 hours of shaking incubation at 37° C., samples were plated on LB-agar plates supplemented with chloramphenicol and harvested after 16 hours. DNA was extracted using NucleoBond Xtra MaxiPrep EF (Machery-Nagel), PCR amplified, and sequenced using a MiSeq (Illumina) with a paired-end 150 cycle kit.

To determine enriched spacers, spacer regions were extracted, counted, and normalized to total reads for each sample. For a given PAM, enrichment was measured as the log ratio compared to input library, with a 0.01 psuedocount adjustment. PAMs above a 1.3 enrichment threshold that occurred in both biological replicates were used to generate sequence logos (G. E. Crooks, G. Hon, J. M. Chandonia, S. E. Brenner, WebLogo: a sequence logo generator. Genome research 14, 1188-1190 (2004)).

To test individual spacers for MS2 interference, the oligos were ordered from IDT, annealed and phosphorylated with polynucleotide kinase (New England Biosciences) and cloned into the locus backbone with Golden Gate cloning. Plasmids were transformed into C3000 strain *E. coli*, made competent with the Mix and Go kit (Zymo Research). C3000 cells were seeded from an overnight culture grown to OD600 of 2, at which point they were diluted 1:13 in Top Agar and poured on LB-chloramphenicol plates. Dilutions of MS2 phage were then spotted on the plates using a multichannel pipette, and the creation of plaques was recorded after overnight incubation.

RFP Targeting Assay

An ampicillin resistant RFP-expressing plasmid (pRFP) was transformed into DH5-alpha cells (New England Biolabs). Cells containing pRFP were then made chemically competent (Zymo Research Mix and Go) to be used for downstream targeting experiments with pLshC2c2. Spacers targeting RFP mRNA were cloned into pLshC2c2 and these plasmids were transformed into the chemically competent DH5-alpha pRFP cells. Cells were then grown overnight under double selection in LB and subjected to analysis by flow cytometry when they reached an OD600 of 4.0. Knockdown efficiency was quantified as the percent of RFP positive cells compared to a non-targeting spacer control (the endogenous LshC2c2 locus in pACYC184).

To interrogate the effect of LshC2c2 activity on the growth of the host cells, we created a TetR-inducible version of the RFP plasmid in pBR322 (pBR322_RFP). We transformed *E. coli* cells with this vector and then made them chemically competent (Zymo Research Mix and Go) to prepare them for downstream experiments. We cloned pLshC2c2 plasmids with various spacers targeting RFP mRNA as well as their reverse complement controls and transformed them into *E. coli* cells carrying pBR322_RFP and streaked them on double-selection plates to maintain both plasmids. Colonies were then picked and grown overnight in LB with double selection. Bacteria were diluted to an OD600 of 0.1 and grown at 37C for 1 hour with chloramphenicol selection only. RFP expression was then induced using 350 ng/mL of anhydrotetracycline and OD measurements were taken every 5 minutes under continuous shaking in a BioTek Synergy 2 microplate reader.

C2c2 Nucleic Acid Preparation

The mammalian codon-optimized gene for C2c2 (*Leptotrichia shahii*) was synthesized (GenScript) and cloned into a bacterial expression plasmid. *E. coli* cells (BL21 (DE3)) were transformed and grown overnight at 37° C. The protein was then purified using histidine-tags and Ni-NTA affinity columns and then further purified using FPLC gel filtration.

Nucleic acid templates for T7 transcription were synthesized from IDT. Templates for crRNAs were annealed to a short T7 primer and incubated with T7 polymerase overnight at 37° C. Templates for targeting in nuclease assays were made double stranded using PCR and then incubated with T7 polymerase at 30° C. overnight.

5' end labeling was accomplished using the 5' oligonucleotide kit (VectorLabs) and with a maleimide-IR800 probe (Licor). 3' end labeling was performed using a 3' oligonucleotide labeling kit (Sigma) using ddUTP-Cy5. Labeled probes were purified using Clean and Concentrator columns (Zymo).

C2c2 Protein Purification

The mammalian codon-optimized gene for C2c2 (*Leptotrichia shahii*) was synthesized (GenScript) and cloned into a bacterial expression vector (6-His-MBP-TEV-Cpf1, a pET based vector kindly given to us by Doug Daniels). 12 liters of Terrific Broth growth media with 100 μg/mL ampicillin was inoculated with 10 mL overnight culture One Shot® BL21(DE3)pLysE (Invitrogen) cells containing the LshC2c2 expression construct. Growth media plus inoculant was grown at 37° C. until the cell density reached 0.2 OD600, then the temperature was decreased to 21° C. Growth was continued until OD600 reached 0.6 when a final concentration of 500 sM IPTG was added to induce MBP-C2c2 expression. The culture was induced for 14-18 hours before harvesting cells and freezing at −80° C. until purification. Cell paste was resuspended in 200 mL of Lysis Buffer (50 mM Hepes pH 7, 2M NaCl, 5 mM MgC2, 20 mM imidazole) supplemented with protease inhibitors (Roche cOmplete, EDTA-free) and lysozyme. Once homogenized, cells were lysed by sonication (Branson Sonifier 450) then centrifuged at 10,000 g for 1 hour to clear the lysate. The lysate was filtered through 0.22 micron filters (Millipore, Stericup) applied to a Ni-NTA superflow nickel resin (Qiagen), washed, and then eluted with a gradient of imidazole. Fractions containing protein of the expected size were pooled, TEV protease (Sigma) was added, and the sample was dialyzed overnight into TEV buffer (500 mM NaCl, 50 mM Hepes pH 7, 5 mM MgCl, 2 mM DTT). After dialysis, TEV cleavage was confirmed by SDS-PAGE, and the sample was concentrated to 500 μL prior to loading on a gel filtration column (HiLoad 16/600 Superdex 200) via FPLC (AKTA Pure). Fractions from gel filtration were analyzed by SDS-PAGE; fractions containing C2c2 were pooled and concentrated to 200 μL and either used directly for biochemical assays or frozen at −80° C. for storage. Gel filtration standards were run on the same column equilibrated in 2M NaCl, Hepes pH 7.0 to calculate the approximate size of LshC2c2.

Nucleic Acid Target Preparation

DNA oligo templates for T7 transcription were ordered from IDT. Templates for crRNAs were annealed to a short T7 primer and incubated with T7 polymerase overnight at 30° C. using the HiScribe T7 Quick High Yield RNA Synthesis kit (New England Biolabs). Target templates were PCR amplified to yield dsDNA and then incubated with T7 polymerase at 30° C. overnight using the same kit.

5' end labeling was accomplished using the 5' oligonucleotide kit (VectorLabs) and with a maleimide-IR800 probe (Licor). 3' end labeling was performed using a 3' oligonucleotide labeling kit (Sigma) using ddUTP-Cy5. Labeled probes were purified using Clean and Concentrator columns (Zymo Research).

Nuclease Assay

Nuclease assays were performed with 160 nM of end-labeled ssRNA target, 200 nM purified LshC2c2, and 100 nM crRNA, unless otherwise indicated, in nuclease assay buffer (40 mM Tris-HCl, 60 mM NaCl, 6 mM MgCl2, pH 7.3). Reactions were allowed to proceed for 1 hour at 37° C. (unless otherwise indicated) and were then quenched with proteinase K and EDTA for 15 minutes at 37° C. The reactions were then denatured with 6M urea denaturing buffer at 95° C. for 5 minutes. Samples were analyzed by gel electrophoresis on 10% PAGE TBE-Urea run at 45° C. Gels were imaged using a Licor Odyssey scanner.

Electrophoretic Mobility Shift Assay

Target ssRNA binding experiments were performed with a series of half-log complex dilutions (crRNA and LshC2c2) from 2 μM to 0.2 μM (or 1 μM to 0.1 μM in the case of R1278A LshC2c2). Binding assays were performed in nuclease assay buffer supplemented with 10 mM EDTA to prevent cutting, 5% glycerol, and 10 μg/mL heparin in order to avoid non-specific interactions of the complex with target RNA. Reactions were incubated at 37° C. for 20 minutes and then resolved on 6% PAGE TBE gels at 4° C. (using 0.5×TBE buffer). Gels were imaged using the Licor Odyssey scanner.

NGS of In Vitro Cleaved RNA

In vitro nuclease assays were performed as described above using unlabeled ssRNA targets. After one hour, samples were quenched with proteinase K+EDTA and then column purified (Zymo Clean and Concentrator). The RNA samples were then PNK and 5' polyphosphatase treated (Epicentre) before preparing a library for NGS using NEB-Next Small RNA Library Prep Set for Illumina sequencing. Libraries were sequenced on an Illumina MiSeq to sufficient depth and analyzed using the alignment tool BWA (H. Li, R. Durbin, Fast and accurate short read alignment with Burrows-Wheeler transform. Bioinformatics 25, 1754-1760 (2009)).

In Vitro Co-Transcriptional DNA Cleavage Assay

The *E. coli* RNAP co-transcriptional DNA cleavage assay was performed essentially as described previously (Samai et al., Cell, 2015). Briefly, 0.8 pmol of ssDNA template strand were annealed with 1.6 pmol of RNA in transcription buffer (from *E. coli* RNAP core enzyme New England Biolabs) without magnesium to prevent RNA hydrolysis. 0.75 ul of *E. coli* RNAP core enzyme and Magnesium were added and the reaction incubated at 25° C. for 30 min and then transferred to 37° C. 1pmol of freshly denatured nontemplate strand (NTS) were added and incubated at 37° C. for 15 min to obtain elongation complexes (ECs). 4 pmol of LshC2C2-crRNA complexes along with 1.25 mM of RNTPs were added to the ECs and transcription was allowed to proceed for 1 h at 37° C. DNA was resolved on a 10% PAGE TBE-Urea gels following RNase and proteinase K treatment.

Aspects of the invention are further described in the following numbered paragraphs:

1. A method of modifying a target locus of interest, the method comprising delivering to said locus a non-naturally occurring or engineered composition comprising a C2c2 effector protein and one or more nucleic acid components, wherein the effector protein forms a complex with the one or more nucleic acid components, the one or more nucleic acid components directs the complex to the target locus of interest and the complex binds to the target locus of interest.
2. The method of numbered paragraph 1, wherein the target locus of interest comprises RNA.
3. The method of numbered paragraph 1 or 2, wherein the modification of the target locus of interest comprises a nucleotide strand break.
4. The method of numbered paragraph 1 or 2, wherein the C2c2 effector protein is codon optimized for expression in a eukaryotic cell.
5. The method of numbered paragraph 1 or 2, wherein the C2c2 effector protein is associated with one or more functional domains; and optionally the effector protein contains one or more mutations optionally within an HEPN Domain, such as R597A, H602A, R1278A, and/or H1283A, whereby the complex can deliver an epigenentic modifier or a transcriptional or translational activation or repression signal.
6. The method of numbered paragraph 5, wherein the functional domain modifies transcription or translation of the target locus.
7. The method of any one of numbered paragraphs 1 to 6, wherein the C2c2 effector protein comprises at least one or more nuclear localization signals.
8. The method of numbered paragraph 1, wherein the target locus of interest is provided via a nucleic acid molecule in vitro.
9. The method of numbered paragraph 1, wherein the target locus of interest is provided via a nucleic acid molecule within a cell.
10. The method of numbered paragraph 9, wherein the cell comprises a prokaryotic cell.
11. The method of numbered paragraph 9, wherein the cell comprises a eukaryotic cell.
12. The method of any one of the preceding numbered paragraph, wherein when in complex with the effector protein the nucleic acid component(s) is capable of effecting sequence specific binding of the complex to a target sequence of the target locus of interest.
13. The method of any one of the preceding numbered paragraphs, wherein the nucleic acid component(s) comprise a dual direct repeat sequence.
14. The method of any one of the preceding numbered paragraphs, wherein the effector protein and nucleic acid component(s) are provided via one or more polynucleotide molecules encoding the polypeptides and/or the nucleic acid component(s), and wherein the one or more polynucleotide molecules are operably configured to express the polypeptides and/or the nucleic acid component(s).
15. The method of numbered paragraph 14, wherein the one or more polynucleotide molecules comprise one or more regulatory elements operably configured to express the polypeptides and/or the nucleic acid component(s), optionally wherein the one or more regulatory elements comprise a promoter(s) or inducible promotor(s).
16. The method of numbered paragraph 14 or 15, wherein the one or more polynucleotide molecules are comprised within one or more vectors.
17. The method of numbered paragraph 14 or 15, wherein the one or more polynucleotide molecules are comprised within one vector.
18. The method of numbered paragraph 16 or 17, wherein the one or more vectors comprise viral vectors.
19. The method of numbered paragraph 18, wherein the one or more viral vectors comprise one or more retroviral, lentiviral, adenoviral, adeno-associated or herpes simplex viral vectors.
20. The method of any one of numbered paragraph 14 to 15 wherein the one or more polynucleotide molecules are comprised in a delivery system, or the method of numbered paragraph 16 or 17 wherein the one or more vectors are comprised in a delivery system, or the method of any one of numbered paragraphs 1-13 wherein the assembled complex are comprised in a delivery system.
21. The method of any one of the preceding numbered paragraphs, wherein the non-naturally occurring or engineered composition is delivered via a delivery vehicle comprising liposome(s), particle(s), exosome(s), microvesicle(s), a gene-gun or one or more viral vector(s).
22. A non-naturally occurring or engineered composition which is a composition having the characteristics as defined in any one of the preceding numbered paragraphs.
23. A non-naturally occurring or engineered composition comprising a C2c2 effector protein and one or more nucleic acid components, wherein the effector protein forms a complex with the one or more nucleic acid components, the one or more nucleic acid components directs the complex to the target of interest and the complex binds to the target locus of interest.
24. The composition of numbered paragraph 23, wherein the target locus of interest comprises RNA.
25. The composition of numbered paragraph 23 or 24, wherein the modification of the target locus of interest comprises a nucleotide strand break.
26. The composition of numbered paragraph 23 or 24, wherein the C2c2 effector protein is codon optimized for expression in a eukaryotic cell.
27. The composition of numbered paragraph 23 or 24, wherein the C2c2 effector protein is associated with one or more functional domains; and optionally the effector protein contains one or more mutations optionally within an HEPN Domain, such as R597A, H602A, R1278A, and/or H1283A, whereby the complex can deliver an epigenentic modifier or a transcriptional or translational activation or repression signal.
28. The composition of numbered paragraph 27, wherein the functional domain modifies transcription or translation of the target locus.
29. The composition of any one of numbered paragraphs 23 to 28, wherein the C2c2 effector protein comprises at least one or more nuclear localization signals.
30. The composition of numbered paragraph 23, wherein the target locus of interest is comprised in a nucleic acid molecule in vitro.
31. The composition of numbered paragraph 23, wherein the target locus of interest is comprised in a nucleic acid molecule within a cell.
32. The composition of numbered paragraph 31, wherein the cell comprises a prokaryotic cell.
33. The composition of numbered paragraph 31, wherein the cell comprises a eukaryotic cell.
34. The composition of any one of numbered paragraphs 23-33, wherein when in complex with the effector protein the nucleic acid component(s) is capable of effecting sequence specific binding of the complex to a target sequence of the target locus of interest.

35. The composition of any one of numbered paragraphs 23-34, wherein the nucleic acid component(s) comprise a dual direct repeat sequence.

36. The composition of any one of numbered paragraphs 23-34, wherein the effector protein and nucleic acid component(s) are provided via one or more polynucleotide molecules encoding the polypeptides and/or the nucleic acid component(s), and wherein the one or more polynucleotide molecules are operably configured to express the polypeptides and/or the nucleic acid component(s).

37. The composition of numbered paragraph 36, wherein the one or more polynucleotide molecules comprise one or more regulatory elements operably configured to express the polypeptides and/or the nucleic acid component(s), optionally wherein the one or more regulatory elements comprise a promoter(s) or inducible promotor(s).

38. The composition of numbered paragraph 36 or 37, wherein the one or more polynucleotide molecules are comprised within one or more vectors.

39. The composition of numbered paragraph 36 or 37, wherein the one or more polynucleotide molecules are comprised within one vector.

40. The composition of numbered paragraph 38 or 39, wherein the one or more vectors comprise viral vectors.

41. The composition of numbered paragraph 40, wherein the one or more viral vectors comprise one or more retroviral, lentiviral, adenoviral, adeno-associated or herpes simplex viral vectors.

42. The composition of any one of numbered paragraphs 36 to 37 wherein the one or more polynucleotide molecules are comprised in a delivery system, or the composition of numbered paragraph 38 or 39 wherein the one or more vectors are comprised in a delivery system, or the composition of any one of numbered paragraphs 23-35 wherein the assembled complex are comprised in a delivery system.

43. The composition of any one of the preceding numbered paragraphs, wherein the non-naturally occurring or engineered composition is delivered via a delivery vehicle comprising liposome(s), particle(s), exosome(s), microvesicle(s), a gene-gun or one or more viral vector(s).

44. A vector system comprising one or more vectors, the one or more vectors comprising one or more polynucleotide molecules encoding components of a non-naturally occurring or engineered composition which is a composition having the characteristics as defined in any one of the preceding numbered paragraphs.

45. A delivery system configured to deliver a C2c2 effector protein and one or more nucleic acid components of a non-naturally occurring or engineered composition which is a composition having the characteristics as defined in any one of the preceding numbered paragraphs.

46. The delivery system of numbered paragraph 45, which comprises one or more vectors or one or more polynucleotide molecules, the one or more vectors or polynucleotide molecules comprising one or more polynucleotide molecules encoding the C2c2 effector protein and one or more nucleic acid components of the non-naturally occurring or engineered composition having the characteristics as defined in any one of the preceding numbered paragraphs.

47. The non-naturally occurring or engineered composition, vector system, or delivery system of any of the preceding or subsequent numbered paragraphs for use in a therapeutic method of treatment.

48. A cell modified according to the method, or engineered to comprise or express, optionally inducibly or constitutively, the composition or a component thereof of any one of the preceding or subsequent numbered paragraphs.

49. The cell according to numbered paragraph 48, wherein the modification results in:
  the cell comprising altered transcription or translation of at least one RNA product;
  the cell comprising altered transcription or translation of at least one RNA product, wherein the expression of the at least one product is increased; or
  the cell comprising altered transcription or translation of at least one RNA product, wherein the expression of the at least one product is decreased.

50. The cell of numbered paragraph 49, wherein the cell comprises a eukaryotic cell.

51. The cell according to any one of numbered paragraph 48 or 49, wherein the comprises a mammalian cell.

52. The cell of numbered paragraph 48 wherein the cell comprises a prokaryotic cell.

53. The non-naturally occurring or engineered composition, vector system, or delivery system of any preceding claim, for use in:
  RNA sequence specific interference,
  RNA sequence specific gene regulation,
  screening of RNA or RNA products or lincRNA or non-coding RNA, or nuclear RNA, or mRNA,
  mutagenesis,
  Fluorescence in situ hybridization,
  breeding,
  in vitro or in vivo induction of cell dormancy,
  in vitro or in vivo induction of cell cycle arrest,
  in vitro or in vivo reduction of cell growth and/or cell proliferation,
  in vitro or in vivo induction of cell anergy,
  in vitro or in vivo induction of cell apoptosis,
  in vitro or in vivo incuction of cell necrosis,
  in vitro or in vivo induction of cell death, or
  in vitro or in vivo induction of programmed cell death.

54. A cell line of or comprising the cell according to any one of numbered paragraphs 48-52, or progeny thereof.

55. A multicellular organism comprising one or more cells according to numbered paragraph 50 or 51.

56. A plant or animal model comprising one or more cells according to any one of numbered paragraphs 48-51; said cell(s) optionally inducibly or constitutively expressing the composition or a component thereof of any one of the preceding numbered paragraphs.

57. A product from a cell of any one of numbered paragraphs, or cell line or the organism of claim or the plant or animal model of any of numbered paragraphs 47-52, 54-56; said cell or cell(s) of the cell line or organism or plant or animal model optionally inducibly or constitutively expressing the composition or a component thereof of any one of the preceding numbered paragraphs.

58. The product of numbered paragraph 57, wherein the amount of product is greater than or less than the amount of product from a cell that has not had alteration or modification by a method or composition of any of the preceding numbered paragraphs.

59. The product of numbered paragraph 57, wherein the product is altered in comparison with the product from a cell that has not had alteration or modification by a method or composition of any of the preceding numbered paragraphs.

60. An assay, screening method or mutagenesis method comprising a system or method or cells of any one of the preceding or subsequent numbered paragraphs.

61. In an RNA-based assay, screening method or mutagenesis method wherein the improvement comprises, instead of using RNA, the method comprises using a composition as in any of the preceding numbered paragraphs.

62. The method of numbered paragraph 61 wherein the RNA-based assay, screening method or mutagenesis method is an RNAi or Fluorescence in situ hybridization method.

63. Use of the non-naturally occurring or engineered composition, vector system, or delivery system of any preceding numbered paragraph for:
RNA sequence specific interference,
RNA sequence specific gene regulation,
screening of RNA or RNA products or lincRNA or non-coding RNA, or nuclear RNA, or mRNA,
mutagenesis,
Fluorescence in situ hybridization,
breeding,
in vitro or in vivo induction of cell dormancy,
in vitro or in vivo induction of cell cycle arrest,
in vitro or in vivo reduction of cell growth and/or cell proliferation,
in vitro or in vivo induction of cell anergy,
in vitro or in vivo induction of cell apoptosis,
in vitro or in vivo incuction of cell necrosis,
in vitro or in vivo induction of cell death, or
in vitro or in vivo induction of programmed cell death.

64. The method according to any of numbered paragraphs 1 to 21, wherein said method results in:
RNA sequence specific interference,
RNA sequence specific gene regulation,
screening of RNA or RNA products or lincRNA or non-coding RNA, or nuclear RNA, or mRNA,
mutagenesis,
Fluorescence in situ hybridization,
breeding,
in vitro or in vivo induction of cell dormancy,
in vitro or in vivo induction of cell cycle arrest,
in vitro or in vivo reduction of cell growth and/or cell proliferation,
in vitro or in vivo induction of cell anergy,
in vitro or in vivo induction of cell apoptosis,
in vitro or in vivo induction of cell necrosis,
in vitro or in vivo induction of cell death, or
in vitro or in vivo induction of programmed cell death.

65. A method for:
RNA sequence specific interference,
RNA sequence specific gene regulation,
screening of RNA or RNA products or lincRNA or non-coding RNA, or nuclear RNA, or mRNA,
mutagenesis,
Fluorescence in situ hybridization,
breeding,
in vitro or in vivo induction of cell dormancy,
in vitro or in vivo induction of cell cycle arrest,
in vitro or in vivo reduction of cell growth and/or cell proliferation,
in vitro or in vivo induction of cell anergy,
in vitro or in vivo induction of cell apoptosis,
in vitro or in vivo induction of cell necrosis,
in vitro or in vivo induction of cell death, or
in vitro or in vivo induction of programmed cell death
comprising introducing or inducing in vitro or in vivo in a target cell the non-naturally occurring or engineered composition, vector system, or delivery system of any preceding numbered paragraph.

66. An engineered, non-naturally occurring CRISPR-Cas system comprising one or more vectors comprising:
a) a first regulatory element operable in a eukaryotic or prokaryotic cell operably linked to at least one nucleotide sequence encoding a CRISPR-Cas system guide RNA that hybridizes with a target sequence of an RNA molecule encoded by a DNA molecule in a eukaryotic or prokaryotic cell, wherein the DNA molecule encodes and the eukaryotic or prokaryotic cell expresses at least one gene product, and
b) a second regulatory element operable in a eukaryotic or prokaryotic cell operably linked to a nucleotide sequence encoding a Type-II C2c2 effector protein, wherein components (a) and (b) are located on same or different vectors of the system,
whereby the guide RNA targets and hybridizes with the target sequence and the C2c2 effector protein cleaves the RNA molecule,
whereby expression of the at least one gene product is altered; and, wherein the C2c2 effector protein and the guide RNA do not naturally occur together.

67. An engineered, non-naturally occurring composition comprising a CRISPR-Cas system, said system comprising a functional CRISPR C2c2 effector protein and guide RNA (gRNA);
wherein the gRNA comprises a dead guide sequence;
whereby the gRNA is capable of hybridizing to a target sequence;
whereby the CRISPR-Cas system is directed to the target sequence with reduced indel activity resultant from nuclease activity of a non-mutant C2c2 effector protein of the system.

68. A method of inhibiting cell growth, the method comprising delivering to the cell a non-naturally occurring or engineered composition comprising a functional CRISPR C2c2 effector protein and guide RNA (gRNA);
whereby the gRNA is capable of hybridizing to a target RNA sequence of the cell;
whereby the CRISPR-Cas system is directed to the target RNA sequence with reduced indel activity resultant from nuclease activity of a non-mutant C2c2 effector protein of the system.

69. A CRISPR associated Cas vector system comprising one or more vectors comprising:
a) a first regulatory element operable in a eukaryotic or prokaryotic cell operably linked to at least one nucleotide sequence encoding a CRISPR-Cas system guide RNA that hybridizes with a target sequence of an RNA molecule encoded by a DNA molecule in a eukaryotic or prokaryotic cell, wherein the DNA molecule encodes and the eukaryotic or prokaryotic cell expresses at least one gene product, and
b) a second regulatory element operable in a eukaryotic or prokaryotic cell operably linked to a nucleotide sequence encoding a Type-II C2c2 effector protein, wherein components (a) and (b) are located on same or different vectors of the system,
whereby the guide RNA targets and hybridizes with the target sequence and the C2c2 effector protein cleaves the RNA molecule,
whereby expression of the at least one gene product is altered; and, wherein the C2c2 effector protein and the guide RNA do not naturally occur together.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (2233 sequences)

SEQ ID NO: 1 - protein, 7 aa, Simian virus 40
PKKKRKV

SEQ ID NO: 2 - protein, 16 aa, Unknown
  Synthetic
  source (1)..(16): /note="Description of Unknown: Nucleoplasmin bipartite NLS sequence"
KRPAATKKAGQAKKKK

SEQ ID NO: 3 - protein, 9 aa, Unknown
  Synthetic
  source (1)..(9): /note="Description of Unknown: C-myc NLS sequence"
PAAKRVKLD

SEQ ID NO: 4 - protein, 11 aa, Unknown
  Synthetic
  source (1)..(11): /note="Description of Unknown: C-myc NLS sequence"
RQRRNELKRSP

SEQ ID NO: 5 - protein, 38 aa, Homo sapiens
NQSSNFGPMKGGNFGGRSSGPYGGGGQYFAKPRNQGGY

SEQ ID NO: 6 - protein, 42 aa, Unknown
  Synthetic
  source (1)..(42): /note="Description of Unknown: IBB domain from importin-alpha sequence"
RMRIZFKNKGKDTAELRRRRVEVSVELRKAKKDEQILKRRNV

SEQ ID NO: 7 - protein, 8 aa, Unknown
  Synthetic
  source (1)..(8): /note="Description of Unknown: Myoma T protein sequence"
VSRKRPRP

SEQ ID NO: 8 - protein, 8 aa, Unknown
  Synthetic
  source (1)..(8): /note="Description of Unknown: Myoma T protein sequence"
PPKKARED

SEQ ID NO: 9 - protein, 8 aa, Homo sapiens
PQPKKKPL

SEQ ID NO: 10 - protein, 12 aa, Mus musculus
SALIKKKKKMAP

SEQ ID NO: 11 - protein, 5 aa, Influenza virus
DRLRR

SEQ ID NO: 12 - protein, 7 aa, Influenza virus
PKQKKRK

SEQ ID NO: 13 - protein, 10 aa, Hepatitis delta virus
RKLKKKIKKL

SEQ ID NO: 14 - protein, 10 aa, Mus musculus
REKKKFLKRR

SEQ ID NO: 15 - protein, 20 aa, Homo sapiens
KRKGDEVDGVDEVAKKKSKK

SEQ ID NO: 16 - protein, 17 aa, Homo sapiens
RKCLQAGMNLEARKTKK

SEQ ID NO: 17 - protein, 4 aa, Unknown
  Synthetic
  source (1)..(4): /note="Description of Unknown: 'KDEL' family motif peptide"
KDEL

SEQ ID NO: 18 - protein, 4 aa, Artificial Sequence
  Synthetic
GGGS

SEQ ID NO: 19 - protein, 15 aa, Artificial Sequence
  Synthetic
GGGGSGGGGSGGGGS

SEQ ID NO: 20 - protein, 30 aa, Artificial Sequence
  Synthetic
GGGGSGGGGSGGGGSGGGGSGGGGSGGGGS

SEQ ID NO: 21 - protein, 45 aa, Artificial Sequence
  Synthetic
GGGGSGGGGSGGGGSGGGGSGGGGSGGGGSGGGGSGGGGSGGGGS

SEQ ID NO: 22 - protein, 60 aa, Artificial Sequence
  Synthetic
GGGGSGGGGSGGGGSGGGGSGGGGSGGGGSGGGGSGGGGSGGGGSGGGGSGGGGSGGGGS

SEQ ID NO: 23 - protein, 12 aa, Artificial Sequence
  Synthetic
  MOD_RES (2)..(2): Aminohexanoyl
  MOD_RES (5)..(5): Aminohexanoyl
  MOD_RES (8)..(8): Aminohexanoyl
  MOD_RES (11)..(11): Aminohexanoyl
RXRRXRRXRRXR

SEQ ID NO: 24 - DNA, 20 bp, Homo sapiens
gagtccgagcagaagaagaa

SEQ ID NO: 25 - DNA, 20 bp, Homo sapiens
gagtcctagcaggagaagaa

SEQ ID NO: 26 - DNA, 20 bp, Homo sapiens
gagtctaagcagaagaagaa

SEQ ID NO: 27 - RNA, 36 nt, Artificial Sequence
  Synthetic
gccgcagcgaaugccguuucacgaaucgucaggcgg

SEQ ID NO: 28 - RNA, 75 nt, Artificial Sequence
  Synthetic
gcuggagacguuuuuugaaacggcgagugcugcggauagcgaguuucucuuggggaggcgcucgcggccacuuuu

SEQ ID NO: 29 - protein, 1388 aa, Unknown
  Synthetic
  source (1)..(1388): /note="Description of Unknown: Opitutaceae bacterium sequence"
MSLNRIYQGRVAAVETGTALAKGNVEWMPAAGGDEVLWQHHELFQAAINYYLVALLALADKNNPVLGPLISQMDNPQSPYHVWGSFRRQGRQRTGLSQAVAPYITPGNNAPTLDEVFRSILAGNPTDRATLDAALMQLLKACDGAGAIQQEGRSYWPKFCDPDSTANFAGDPAMLRREQHRLLLPQVLHDPAITHDSPALGSFDTYSIATPDTRTPQLTGPKARARLEQAITLWRVRLPESAADFDRLASSLKKIPDDDSRLNLQGYVGSSAKGEVQARLFALLLFRHLERSSFTLGLLRSATPPPKNAETPPPAGVPLPAASAADPVRIARGKRSFVFRAFTSLPCWHGGDNIHPTWKSFDIAAFKYALTVINQIEEKTKERQKECAELETDFDYMHGRLAKIPVKYTTGEAEPPPILANDLRIPLLRELLQNIKVDTALTDGEAVSYGLQRRTIRGFRELRRIWRGHAPAGTVFSSELKEKLAGELRQFQTDNSTTIGSVQLFNELIQNPKYWPIWQAPDVETARQWADAGFADDPLAALVQEAELQEDIDALKAPVKLTPADPEYSRRQYDFNAVSKFGAGSRSANRHEPGQTERGHNTFTTEIAARNAADGNRWRATHVRIHYSAPRLLRDGLRRPDTDGNEALEAVPWLQPMMEALAPLPTLPQDLTGMPVFLMPDVTLSGERRILLNLPVTLEPAALVEQLGNAGRWQNQFFGSREDPFALRWPADGAVKTAKGKTHIPWHQDRDHFTVLGVDLGTRDAGALALLNVTAQKPAKPVHRIIGEADGRTWYASLADARMIRLPGEDARLFVRGKLVQEPYGERGRNASLLEWEDARNIILRLGQNPDELLGADPRRHSYPEINDKLLVALRRAQARLARLQNRSWRLRDLAESDKALDEIHAERAGEKPSPLPPLARDDAIKSTDEALLSQRDIIRRSFVQIANLILPLRGRRWEWRPHVEVPDCHILAQSDPGTDDTKRLVAGQRGISHERIEQIEELRRRCQSLNRALRHKPGERPVLGRPAKGEEIADPCPALLEKINRLRDQRVDQTAHAILAAALGVRLRAPSKDRAERRHRDIHGEYERFRAPADFVVIENLSRYLSSQDRARSENTRLMQWCHRQIVQKLRQLCETYGIPVLAVPAAYSSRFSSRDGSAGFRAVHLTPDHRHRMPWSRILARLKAHEEDGKRLEKTVLDEARAVRGLFDRLDRFNAGHVPGKPWRTLLAPLPGGPVFVPLGDATPMQADLNAAINIALRGIAAPDRHDIHHRLRAENKKRILSLRLGTQREKARWPGGAPAVTLSTPNNGASPEDSDALPERVSNLFVDIAGVANFERVTIEGVSQKFATGRGLWASVKQRAWNRVARLNETVTDNNRNEEEDDIPM

SEQ ID NO: 30 - RNA, 36 nt, Artificial Sequence
  Synthetic
guccaagaaaaaagaaaugauacgaggcauuagcac

SEQ ID NO: 31 - RNA, 107 nt, Artificial Sequence
  Synthetic
cuggacgaugucucuuuuauuucuuuuuucuuggaucugaguacgagcacccacauuggacauuucgcauggugggugcucguacuauagguaaaacaaaccuuuuu

SEQ ID NO: 32 - protein, 1108 aa, Bacillus thermoamylovorans
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 33 - RNA, 36 nt, Artificial Sequence
  Synthetic
guucgaaagcuuaguggaaagcuucgugguuagcac

SEQ ID NO: 34 - RNA, 69 nt, Artificial Sequence
  Synthetic
cacggauaaucacgacuuuccacuaagcuuucgaauuuuaugaugcgagcauccucucaggucaaaaaa

SEQ ID NO: 35 - protein, 1108 aa, Bacillus sp.
MAIRSIKLKLKTHTGPEAQNLRKGIWRTHRLLNEGVAYYMKMLLLFRQESTGERPKEELQEELICHIREQQQRNQADKNTQALPLDKALEALRQLYELLVPSSVGQSGDAQIISRKFLSPLVDPNSEGGKGTSKAGAKPTWQKKKEANDPTWEQDYEKWKKRREEDPTASVITTLEEYGIRPIFPLYTNTVTDIAWLPLQSNQFVRTWDRDMLQQAIERLLSWESWNKRVQEEYAKLKEKMAQLNEQLEGGQEWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFSVEESSDKNAADFSYWIEGTPLVAVHQRSYMLRLPGEQVEKQVMEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRTRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 36 - RNA, 35 nt, Artificial Sequence
  Synthetic
guuuugagaauagcccgacauagagggcaauagac

SEQ ID NO: 37 - RNA, 36 nt, Artificial Sequence
  Synthetic
guuaugaaaacagcccgacauagagggcaauagaca

SEQ ID NO: 38 - protein, 1334 aa, Unknown
  Synthetic
  source (1)..(1334): /note="Description of Unknown: Lachnospiraceae bacterium sequence"
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 39 - RNA, 36 nt, Artificial Sequence
  Synthetic
guuuuaguccucuuucauauagagguagucucuuac

SEQ ID NO: 40 - RNA, 99 nt, Artificial Sequence
  Synthetic
augaaaagaggacuaaaacugaaagaggacuaaaacaccagauguggauaacuauauuaguggcuauuaaaaauucgucgauauuagagaggaaacuuu

SEQ ID NO: 41 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 42 - RNA, 36 nt, Artificial Sequence
  Synthetic
guuuuaguccccuucguuuuugggguagucuaaauc

SEQ ID NO: 43 - RNA, 113 nt, Artificial Sequence
  Synthetic
gauuuagagcaccccaaaaguaaugaaaauuugcaauuaaauaaggaauauuaaaaaaaugugauuuuaaaaaaauugaagaaauuaaaugaaaaauuguccaaguaaaaaaa

SEQ ID NO: 44 - RNA, 70 nt, Artificial Sequence
  Synthetic
auuuagauuaccccuuuaauuuauuuuaccauauuuuucucauaaugcaaacuaauauuccaaaauuuuu

SEQ ID NO: 45 - protein, 1389 aa, Leptotrichia wadei
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 46 - RNA, 36 nt, Artificial Sequence
  Synthetic
guuuuaguccccuucgauauugggguggucuauauc

SEQ ID NO: 47 - RNA, 95 nt, Artificial Sequence
  Synthetic
auugaugugguauacuaaaaauggaaaauuguauuuuugauuagaaagauguaaaauugauuuaauuuaaaaauauuuuauuagauuaaaguaga

SEQ ID NO: 48 - protein, 1300 aa, Leptotrichia shahii
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 49 - RNA, 36 nt, Artificial Sequence
  Synthetic
gucuaagaacuuuaaauaauuucuacuguuguagau

SEQ ID NO: 50 - RNA, 71 nt, Artificial Sequence
  Synthetic
aucuacaaaauuauaaacuaaauaaagauucuuauaauaacuuuauauauaaucgaaauguagagaauuuu

SEQ ID NO: 51 - protein, 1300 aa, Francisella ularensis; identical to SEQ ID NO: 48

SEQ ID NO: 52 - DNA, 138 bp, Artificial Sequence
  Synthetic
aaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 53 - protein, 1388 aa, Artificial Sequence; identical to SEQ ID NO: 29
  Synthetic

SEQ ID NO: 54 - protein, 1108 aa, Artificial Sequence; identical to SEQ ID NO: 32
  Synthetic

SEQ ID NO: 55 - protein, 1108 aa, Artificial Sequence; identical to SEQ ID NO: 35
  Synthetic

SEQ ID NO: 56 - protein, 1334 aa, Artificial Sequence; identical to SEQ ID NO: 38
  Synthetic

SEQ ID NO: 57 - protein, 1120 aa, Artificial Sequence; identical to SEQ ID NO: 41
  Synthetic

SEQ ID NO: 58 - protein, 1152 aa, Artificial Sequence
  Synthetic
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 59 - protein, 1389 aa, Artificial Sequence; identical to SEQ ID NO: 45
  Synthetic

SEQ ID NO: 60 - protein, 1300 aa, Artificial Sequence; identical to SEQ ID NO: 48
  Synthetic

SEQ ID NO: 61 - DNA, 7403 bp, Artificial Sequence
  Synthetic
tatccggtcgaatcgagaatgacgaccgctacgtcttggactacgaagccgtggcccttgccgatgctctcggtgtggatgttgccgacctgttccgcaagatcgattgccccaagaacctgctgcgcaggcgggcagggtaggggagcggtttccggcggagattttcggaggcgccggtaacgttatgtcggggaatttgctatacatcgacgataattagttttgttgattcaggatcgaaatgcgctcaaacaaagaacgttccgcgtttccctcatgcgctactacgcccacaccgccatctttcggcacgcaaacaaagcagatgggttgcctgtcaatgggtgatcattgcctgaagttaccatccatcaataatataaatcatccttactccgaatgtccctcaatcgcatctatcaaggccgcgtggcggccgtcgaaacaggaacggccttagcgaaaggtaatgtcgaatggatgcctgccgcaggaggcgacgaagttctctggcagcaccacgaacttttccaagctgccatcaactactatctcgtcgccctgctcgcactcgccgacaaaaacaatcccgtacttggcccgctgatcagccagatggataatccccaaagcccttaccatgtctggggaagtttccgccgccaaggacgtcagcgcacaggtctcagtcaagccgttgcaccttatatcacgccgggcaataacgctcccacccttgacgaagttttccgctccattcttgcgggcaacccaaccgaccgcgcaactttggacgctgcactcatgcaattgctcaaggcttgtgacggcgcgggcgctatccagcaggaaggtcgttcctactggcccaaattctgcgatcctgactccactgccaacttcgcgggagatccggccatgctccggcgtgaacaacaccgcctcctccttccgcaagttctccacgatccggcgattactcacgacagtcctgcccttggctcgttcgacacttattcgattgctacccccgacaccagaactcctcaactcaccggccccaaggcacgcgcccgtcttgagcaggcgatcaccctctggcgcgtccgtcttcccgaatcggctgctgacttcgatcgccttgccagttccctcaaaaaaattccggacgacgattctcgccttaaccttcagggctacgtcggcagcagtgcgaaaggcgaagttcaggcccgtcttttcgcccttctgctattccgtcacctggagcgttcctcctttacgcttggccttctccgttccgccaccccgccgcccaagaacgctgaaacacctcctcccgccggcgttcctttacctgcggcgtccgcagccgatccggtgcggatagcccgtggcaaacgcagttttgtttttcgcgcattcaccagtctcccctgctggcatggcggtgataacatccatcccacctggaagtcattcgacatcgcagcgttcaaatatgccctcacggtcatcaaccagatcgaggaaaagacgaaagaacgccaaaaagaatgtgcggaacttgaaactgatttcgactacatgcacggacggctcgccaagattccggtaaaatacacgaccggcgaagccgaaccgccccccattctcgcaaacgatctccgcatccccctcctccgcgaacttctccagaatatcaaggtcgacaccgcactcaccgatggcgaagccgtctcctatggtctccaacgccgcaccattcgcggtttccgcgagctgcgccgcatctggcgcggccatgcccccgctggcacggtcttttccagcgagttgaaagaaaaactagccggcgaactccgccagttccagaccgacaactccaccaccatcggcagcgtccaactcttcaacgaactcatccaaaacccgaaatactggcccatctggcaggctcctgacgtcgaaaccgcccgccaatgggccgatgccggttttgccgacgatccgctcgccgcccttgtgcaagaagccgaactccaggaagacatcgacgccctcaaggctccagtcaaactcactccggccgatcctgagtattcaagaaggcaatacgatttcaatgccgtcagcaaattcggggccggctcccgctccgccaatcgccacgaacccgggcagacggagcgcggccacaacacctttaccaccgaaatcgccgcccgtaacgcggcggacgggaaccgctggcgggcaacccacgtccgcatccattactccgctccccgccttcttcgtgacggactccgccgacctgacaccgacggcaacgaagccctggaagccgtcccttggctccagcccatgatggaagccctcgcccctctcccgacgcttccgcaagacctcacaggcatgccggtcttcctcatgcccgacgtcaccctttccggtgagcgtcgcatcctcctcaatcttcctgtcaccctcgaaccagccgctcttgtcgaacaactgggcaacgccggtcgctggcaaaaccagttcttcggctcccgcgaagatccattcgctctccgatggcccgccgacggtgctgtaaaaaccgccaaggggaaaacccacataccttggcaccaggaccgcgatcacttcaccgtactcggcgtggatctcggcacgcgcgatgccggggcgctcgctcttctcaacgtcactgcgcaaaaaccggccaagccggtccaccgcatcattggtgaggccgacggacgcacctggtatgccagccttgccgacgctcgcatgatccgcctgcccggggaggatgcccggctctttgtccggggaaaactcgttcaggaaccctatggtgaacgcgggcgaaacgcgtctcttctcgaatgggaagacgcccgcaatatcatccttcgccttggccaaaatcccgacgaactcctcggcgccgatccccggcgccattcgtatccggaaataaacgataaacttctcgtcgcccttcgccgcgctcaggcccgtcttgcccgtctccagaaccggagctggcggttgcgcgaccttgcagaatcggacaaggcccttgatgaaatccatgccgagcgtgccggggagaagccttctccgcttccgcccttggctcgcgacgatgccatcaaaagcaccgacgaagccctcctttcccagcgtgacatcatccggcgatccttcgttcagatcgccaacttgatccttccccttcgcggacgccgatgggaatggcggccccatgtcgaggtcccggattgccacatccttgcgcagagcgatcccggtacggatgacaccaagcgtcttgtcgccggacaacgcggcatctctcacgagcgtatcgagcaaatcgaagaactccgtcgtcgctgccaatccctcaaccgtgccctgcgtcacaaacccggagagcgtcccgtgctcggacgccccgccaagggcgaggaaatcgccgatccctgtcccgcgctcctcgaaaagatcaaccgtctccgggaccagcgcgttgaccaaaccgcgcatgccatcctcgccgccgctctcggtgttcgactccgcgccccctcaaaagaccgcgccgaacgccgccatcgcgacatccatggcgaatacgaacgctttcgtgcgcccgctgattttgtcgtcatcgaaaacctctcccgttatctcagctcgcaggatcgtgctcgtagtgaaaacacccgtctcatgcagtggtgccatcgccagatcgtgcaaaaactccgtcagctctgcgagacctacggcatccccgtcctcgccgtcccggcggcctactcatcgcgtttttcttcccgggacggctcggccggattccgggccgtccatctgacaccggaccaccgtcaccggatgccatggagccgcatcctcgcccgcctcaaggcccacgaggaagacggaaaaagactcgaaaagacggtgctcgacgaggctcgcgccgtccggggactctttgaccggctcgaccggttcaacgccgggcatgtcccgggaaaaccttggcgcacgctcctcgcgccgctccccggcggccctgtgtttgtccccctcggggacgccacacccatgcaggccgatctgaacgccgccatcaacatcgccctccggggcatcgcggctcccgaccgccacgacatccatcaccggctccgtgccgaaaacaaaaaacgcatcctgagcttgcgtctcggcactcagcgcgagaaagcccgctggcctggaggagctccggcggtgacactctccactccgaacaacggcgcctctcccgaagattccgatgcgttgcccgaacgggtatccaacctgtttgtggacatcgccggtgtcgccaacttcgagcgagtcacgatcgaaggagtctcgcaaaaattcgccaccgggcgtggcctttgggcctccgtcaagcaacgtgcatggaaccgcgttgccagactcaacgagacagtaacagataacaacaggaacgaagaggaggacgacattccgatgtaaccattgcttcattacatctgagtctcccctcaatccctctgccccatgcgtgatataacctccacctcatgtcccggatcggcgccggcaacctgtagttcccttccatcctccaacactcccgcagatcgcgatccgctgccgccgatgccggtgcgccgccttcacaactatctctactgtccgcggcttttttatctccagtgggtcgagaatctctttgaggaaaatgccgacaccattgccggcagcgccgtgcatcgtcacgccgacaaacctacgcgttacgatgatgaaaaagccgaggcacttcgcactggtctccctgaaggcgcgcacatacgcagccttcgcctggaaaacgcccaactcggtctcgttggcgtggtggatatcgtggagggaggccccgacggactcgaactcgtcgactacaaaaaaggttccgccttccgcctcgacgacggcacgctcgctcccaaggaaaacgacaccgtgcaacttgccgcctacgctcttctcctggctgccgatggtgcgcgcgttgcgcccatggcgacggtctattacgctgccgatcgccggcgtgtcaccttcccgctcgatgacgccctctacgcccgcacccgttccgccctcgaagaggcccgcgccgttgcaacctcggggcgcatacctccgccgctcgtctctgacgtccgctgcctccattgttcctcctatgcgctttgccttccccgcgagtccgcctggtggtgccgccatcgcagcacgccgcggggagccggccacacccccatgttgccgggctttgaggatgacgccgccgccattcaccaaatctccgaacctgacaccgagccaccacccgatcttgccagccagcctccccgtcccccgcggctcgatggagaattgttggttgtccagactccgggagcgatgatcggacaaagcggcggtgagtttaccgtgtccgtcaagggtgaggttttgcgcaagcttccggttcatcaactccgggccatttacgtttacggagccgtgcaactcacggcgcatgctgtgcagaccgcccttgaggaggatatcgacgtctcctattttgcgcccagcggccgctttcttggcctcctccgcggcctgcccgcatccggcgtggatgcgcgtctcgggcaatacaccctgtttcgcgaaccctttggccgtctccgtctcgcctgcgaggcgattcgggccaagatccataaccagcgcgtcctcctcatgcgtaacggcgagcccggggagggcgtcttgcgcgaactcgcccgtctgcgcgacgccaccagtgaggcgacttcgctcgacgaactcctcggcatcgagggcatcgccgcgcatttctatttccagtattttcccaccatgctgaaagaacgggcggcctgggcctttgatttttccggacgcaatcgccgcccgccgcgcgacccggtcaacgccctgctttcgttcggttacagcgtgttgtccaaggaacttgccggcgtctgccacgctgttggcctagacccgtttttcggcttcatgcaccagccgcgttacgggcgccccgcactcgctctcgatctgatggaggagtttcgccctctcatcgccgacagtgttgccctgaatctcatcaaccgtggcgaactcgacgaaggggactttatccggtcggccaatggcaccgcgctcaatgatcggggccgccggcgtttttgggaggcatggttccggcgtctcgacagcgaagtcagccatcctgaatttggttacaagatgagctatcgacggatgcttgaagtgcaggcgcgccagctatggcgctatgtgcgcggtgacgccttccgctaccacggattcaccacccgttgattccgatgtcagatccccgccgccgttatcttgtgtgttacgacatcgccaatccgaagcgattgcgccaagtggccaagctgctggagagctatggcacgcgtctgcaatactcggttttcgaatgtcctttggacgatcttcgtcttgaacaggcgaaggctgatttgcgcgacacgattaatgccgaccaagaccaggtgttatttgtttcgcttggccccgaagccaacgatgccacgttgatcatcgccacgcttgggctcccttataccgtgcgctcgcgagtgacgattatctgacccataacccacgtgttgaagaggctgaaaacagacggacctctatgaagaacaattgacgttttggccgaactcagcagacctttatgcggctaaggccaatgatcatccatcctaccgccattgggctggagacgttttttgaaacggcgagtgctgcggatagcgagtttctcttggggaggcgctcgcggccacttttacagaggagatgttcgggcgaactggccgacctaacaaggcgtacccggctcaaaatcgaggcacgctcgcacgggatgatgtaattcgttgtttttcagcataccgtgcgagcacgggccgcagcgaatgccgtttcacgaatcgtcaggcggcggggagaagtcatttaataaggccactgttaaaagccgcagcgaatgccgtttcacgaatcgtcaggcgggcagtggatgtttttccatgaggcgaagaatttcatcgccgcagtgaatgccgtttcaccattgatgaagaatgcgaggtgaaaacagagaaattgggtcaactctatcactcttattcagccatcgtttcaagaaaggatacctcgtattggatacaacacagctcgttcgttctctctacctccctcgacaatctcaagga

SEQ ID NO: 62 - DNA, 6789 bp, Artificial Sequence
  Synthetic
taataaaattgaaatatcactatggattattgtaatattaccataaagataggtgacgtttttttgaaaattgtaaacctaatttgaagaaaaccaattaaaaatcgcttcggcttttttttaagtgccaggtagcattgatgctaacccatgtgtaataaaggtttgttttccttcggggcacgaacacattataagggaaacctaaagattccctttcttgtttaatattataaccagtgaaaataagaataatgcacctaaaactaatatacagaaaataagaattaaaagtactaatatatacatcatatgttatcctccaatgctttattttttaataattgatgttagtattagttttattttaatttctaaacataagaatttgaaaaggatgtgtttattatggcgacacgcagttttattttaaaaattgaaccaaatgaagaagttaaaaagggattatggaagacgcatgaggtattgaatcatggaattgcctactacatgaatattctgaaactaattagacaggaagctatttatgaacatcatgaacaagatcctaaaaatccgaaaaaagtttcaaaagcagaaatacaagccgagttatgggattttgttttaaaaatgcaaaaatgtaatagttttacacatgaagttgacaaagatgttgtttttaacatcctgcgtgaactatatgaagagttggtccctagttcagtcgagaaaaagggtgaagccaatcaattatcgaataagtttctgtacccgctagttgatccgaacagtcaaagtgggaaagggacggcatcatccggacgtaaacctcggtggtataatttaaaaatagcaggcgacccatcgtgggaggaagaaaagaaaaaatgggaagaggataaaaagaaagatccccttgctaaaatcttaggtaagttagcagaatatgggcttattccgctatttattccatttactgacagcaacgaaccaattgtaaaagaaattaaatggatggaaaaaagtcgtaatcaaagtgtccggcgacttgataaggatatgtttatccaagcattagagcgttttctttcatgggaaagctggaaccttaaagtaaaggaagagtatgaaaaagttgaaaaggaacacaaaacactagaggaaaggataaaagaggacattcaagcatttaaatcccttgaacaatatgaaaaagaacggcaggagcaacttcttagagatacattgaatacaaatgaataccgattaagcaaaagaggattacgtggttggcgtgaaattatccaaaaatggctaaagatggatgaaaatgaaccatcagaaaaatatttagaagtatttaaagattatcaacggaaacatccacgagaagccggggactattctgtctatgaatttttaagcaagaaagaaaatcattttatttggcgaaatcatcctgaatatccttatttgtatgctacattttgtgaaattgacaaaaaaaagaaagacgctaagcaacaggcaacttttactttggctgacccgattaaccatccgttatgggtacgatttgaagaaagaagcggttcgaacttaaacaaatatcgaattttaacagagcaattacacactgaaaagttaaaaaagaaattaacagttcaacttgatcgtttaatttatccaactgaatccggcggttgggaggaaaaaggtaaagtagatatcgttttgttgccgtcaagacaattttataatcaaatcttccttgatatagaagaaaaggggaaacatgcttttacttataaggatgaaagtattaaattcccccttaaaggtacacttggtggtgcaagagtgcagtttgaccgtgaccatttgcggagatatccgcataaagtagaatcaggaaatgttggacggatttattttaacatgacagtaaatattgaaccaactgagagccctgttagtaagtctttgaaaatacatagggacgatttccccaagttcgttaattttaaaccgaaagagctcaccgaatggataaaagatagtaaagggaaaaaattaaaaagtggtatagaatcccttgaaattggtctacgggtgatgagtatcgacttaggtcaacgtcaagcggctgctgcatcgatttttgaagtagttgatcagaaaccggatattgaagggaagttattttttccaatcaaaggaactgagctttatgctgttcaccgggcaagttttaacattaaattaccgggtgaaacattagtaaaatcacgggaagtattgcggaaagctcgggaggacaacttaaaattaatgaatcaaaagttaaactttctaagaaatgttctacatttccaacagtttgaagatatcacagaaagagagaagcgtgtaactaaatggatttctagacaagaaaatagtgatgttcctcttgtatatcaagatgagctaattcaaattcgtgaattaatgtataaaccctataaagattgggttgcctttttaaaacaactccataaacggctagaagtcgagattggcaaagaggttaagcattggcgaaaatcattaagtgacgggagaaaaggtctttacggaatctccctaaaaaatattgatgaaattgatcgaacaaggaaattccttttaagatggagcttacgtccaacagaacctggggaagtaagacgcttggaaccaggacagcgttttgcgattgatcaattaaaccacctaaatgcattaaaagaagatcgattaaaaaagatggcaaatacgattatcatgcatgccttaggttactgttatgatgtaagaaagaaaaagtggcaggcaaaaaatccagcatgtcaaattattttatttgaagatttatctaactacaatccttacgaggaaaggtcccgttttgaaaactcaaaactgatgaagtggtcacggagagaaattccacgacaagtcgccttacaaggtgaaatttacggattacaagttggggaagtaggtgcccaattcagttcaagattccatgcgaaaaccgggtcgccgggaattcgttgcagtgttgtaacgaaagaaaaattgcaggataatcgcttttttaaaaatttacaaagagaaggacgacttactcttgataaaatcgcagttttaaaagaaggagacttatatccagataaaggtggagaaaagtttatttctttatcaaaggatcgaaagttggtaactacgcatgctgatattaacgcggcccaaaatttacagaagcgtttttggacaagaacacatggattttataaagtttactgcaaagcctatcaggttgatggacaaactgtttatattccggagagcaaggaccaaaaacaaaaaataattgaagaatttggggaaggctattttattttaaaagatggtgtatatgaatggggtaatgcggggaaactaaaaattaaaaaaggttcctctaaacaatcatcgagtgaattagtagattcggacatactgaaagattcatttgatttagcaagtgaacttaagggagagaaactcatgttatatcgagatccgagtggaaacgtatttccttccgacaagtggatggcagcaggagtattttttggcaaattagaaagaatattgatttctaagttaacaaatcaatactcaatatcaacaatagaagatgattcttcaaaacaatcaatgtaaaagtttgcccgtataagaacttaattaattaggatggtaggatgttactaaatatgtctgtaggcatcattcctactatccgttttgtccgaatatcagagcattaggtgaggaatggtaagaaaggaaaatttatatgaaccaaccgattcctattcgaatgttaaatgaaatacaatattgtgagcgacttttttactttatgcatgtccaaaagctatttgatgagaatgcagatacagttgaaggaagtgcacagcatgagcgggcagaaagaagcaaaagaccaagtaaaatgggaccaaaggaattatggggtgaggcgccaagaagtcttaagcttggtgatgagctgttaaatattaccggtgttcttgatgccataagtcatgaagagaacagttggatcccggttgaatcaaaacacagttccgcaccggatggattgaacccttttaaagtagatggctttctacttgacgggtctgcatggccaaacgatcaaattcaactttgtgcacaaggcttgctcttgaatgccaatggatacccgtgtgattatgggtatttattttatcgtggtaataagaaaaaggtgaaaatttattttactgaagatttaatcgctgccacaaagtactatattaaaaaagcacacgagatactagtattatctggtgatgaatcagctattcctaagcctttaattgattctaataagtgttttcgctgttctttaaactatatctgtcttccggatgaaacgaactatctattaggggcaagttcaacaattcgtaaaattgtgccttcaaggacagatggtggcgttttatatgtatcagagtctggtacaaaattaggaaaatcgggtgaggagttaatcattcagtataaagatggccaaaagcagggtgttcctataaaagatattattcaagtttcgttaattggaaatgttcaatgctcaacgcaattacttcattttttaatgcaatcaaatattcctgtaagttatttatcatcccacggtcgtttgattggtgtcagttcatctttagttacaaaaaatgttttaacaaggcagcaacagttcattaaatttacaaatcctgagtttggactaaatctagcaaaacaaattgtttatgccaagattcgaaatcaacgaactttacttagaagaaatggggggagtgaggtaaaggagattttaacagatttaaaatctttaagtgacagtgcactgaacgcaatatcaatagaacaattacggggtattgaagggatttctgcaaaacattatttcgcaggatttccgtttatgttgaaaaatgaattacgtgaattgaatttaatgaaagggcgtaataggagaccgccaaaagatcctgtaaatgtacttctttctcttggttatactttattgacacgtgatattcatgctgcgtgtggttcagtcggattggatccgatgtttggttgttaccatcgtccagaagcaggtcgaccggctctagtattagatgttatggaaacatttcgaccacttattgtagacagtattgtcatccgagctttgaatacgggtgaaatctcattaaaagatttttatataggaaaagatagttgtcaattattaaaacatggccgcgattccttttttgccatttatgaaagaagaatgcatgaaactattaccgatccaattttcggctataagattagctatcgccgtatgctcgatttgcacattcgaatgcttgcaaggtttattgaaggggaactgccggaatataaaccattaatgacccggtgagtttgtttattaggttaaaagaaggtgaagacatgcagcaatacgtccttgtttcttatgatatttcggaccaaaaaagatggagaaaagtatttaaactgatgaaaggatacggagaacatgttcaatattccgtattcatatgccagttaactgaattacagaaggcaaaattacaagcctctttagaagacattatccatcataagaatgaccaagtaatgtttgttcacatcgggccagtgaaagatggtcaactatctaaaaaaatctcaacaattgggaaagaatttgttccattggatttaaagcggcttatattttgaaaagatatagcaaagaaatcttatgaaaaaaatacaaaaatatattgttaaaaaatagggaatattatataatggacttacgaggttctgtcttttggtcaggacaaccgtctagctataagtgctgcaggggtgtgagaaactcctattgctggacgatgtctcttttatttcttttttcttggatctgagtacgagcacccacattggacatttcgcatggtgggtgctcgtactataggtaaaacaaacctttttaagaagaatacaaaaataaccacaatattttttaaaaggaattttgatggatttacataacctctcgcaacatgcttctaaaacccaagcccaccatagcccaaaaccccctgcggtccaagaaaaaagaaatgatacgaggcattagcaccggggagaagtcatttaataaggccactgttaaaagtccaagaaaaaagaaatgatacgaggcattagcacaacaatataaacgactactttaccgtgttcaagaaaaaagaaatgatatgaggcattagcacgatgggatgggagagagaggacagttctactcttgctgtatccagcttcttttactttatccggtatcatttcttcacttctttctgcacataaaaaagcacctaactatttggataagttaagtgcttttatttccgtttgaagttgtctattgcttttttcttcatatcttcaaattttttctgtttctcagagtcaactttaccaactgtaatcccttttctttttggcattggggtatctttccaccttagtgtgttcataaggcttatatttatcactcattgtattcctccaacacaattataatttttccgtcatcctcaatccaaccgtcaactgtgacaaaagacgaatctctcttat

SEQ ID NO: 63 - DNA, 6214 bp, Artificial Sequence
  Synthetic
gtttcatttggaaagggagagcattggcttttctctttgtaaataaagtgcaagctttgtaataagcttctagtggagaagtgattgtttgaatcacccaatgcacacgcactaaagttagacgaacctataattcgtattagtaagtatagtacatgaagaaaaatgcaacaagcatttactctcttttaaataaagaattgatagctgttaatattgatagtatattataccttatagatgttcgattttttttgaaattcaaaaatcatacttagtaaagaaaggaaataacgtcatggacaagcgaaagcgtagaagttacgagtttaggtgggaagcgggaggcaccagtcatggcaatccgtagcataaaactaaaactaaaaacccacacaggcccggaagcgcaaaacctccgaaaaggaatatggcggacgcatcggttgttaaatgaaggcgtcgcctattacatgaaaatgctcctgctctttcgtcaggaaagcactggtgaacggccaaaagaagaactacaggaagaactgatttgtcacatacgcgaacagcaacaacgaaatcaggcagataaaaatacgcaagcgcttccgctagataaggcactggaagctttgcgccaactatatgaactgcttgtcccctcctcggtcggacaaagtggcgacgcccagatcatcagccgaaagtttctcagcccgctcgtcgatccgaacagcgaaggcggcaaaggtacttcgaaggcaggggcaaaacccacttggcagaagaaaaaagaagcgaacgacccaacctgggaacaggattacgaaaaatggaaaaaaagacgcgaggaagacccaaccgcttctgtgattactactttggaggaatacggcattagaccgatctttcccctgtacacgaacaccgtaacagatatcgcgtggttgccacttcaatccaatcagtttgtgcgaacctgggacagagacatgcttcaacaagcgattgaaagactgctcagttgggagagctggaacaaacgtgtccaggaagagtatgccaagctgaaagaaaaaatggctcaactgaacgagcaactcgaaggcggtcaggaatggatcagcttgctagagcagtacgaagaaaaccgagagcgagagcttagggaaaacatgaccgctgccaatgacaagtatcggattaccaagcggcaaatgaaaggctggaacgagctgtacgagctatggtcaacctttcccgccagtgccagtcacgagcaatacaaagaggcgctcaagcgtgtgcagcagcgactgagagggcggtttggggatgctcatttcttccagtatctgatggaagagaagaaccgcctgatctggaaggggaatccgcagcgtatccattattttgtcgcgcgcaacgaactgacgaaacggctggaggaagccaagcaaagcgccacgatgacgttgcccaatgccaggaagcatccattgtgggtgcgcttcgatgcacggggaggaaatttgcaagactactacttgacggctgaagcggacaaaccgagaagcagacgttttgtaacgtttagtcagttgatatggccaagcgaatcgggatggatggaaaagaaagacgtcgaggtcgagctagctttgtccaggcagttttaccagcaggtgaagttgctgaaaaatgacaaaggcaagcagaaaatcgagttcaaggataaaggttcgggctcgacgtttaacggacacttggggggagcaaagctacaactggagcggggcgatttggagaaggaagaaaaaaacttcgaggacggggaaatcggcagcgtttaccttaacgttgtcattgatttcgaacctttgcaagaagtgaaaaatggccgcgtgcaggcgccgtatggacaagtactgcaactcattcgtcgccccaacgagtttcccaaggtcactacctataagtcggagcaacttgttgaatggataaaagcttcgccacaacactcggctggggtggagtcgctggcatccggttttcgtgtaatgagcatagaccttgggctgcgcgcggctgcagcgacttctattttttctgtagaagagagtagcgataaaaatgcggctgatttttcctactggattgaaggaacgccgctggtcgctgtccatcagcggagctatatgctcaggttgcctggtgaacaggtagaaaaacaggtgatggaaaaacgggacgagcggttccagctacaccaacgtgtgaagtttcaaatcagagtgctcgcccaaatcatgcgtatggcaaataagcagtatggagatcgctgggatgaactcgacagcctgaaacaagcggttgagcagaaaaagtcgccgctcgatcaaacagaccggacattttgggaggggattgtctgcgacttaacaaaggttttgcctcgaaacgaagcggactgggaacaagcggtagtgcaaatacaccgaaaagcagaggaatacgtcggaaaagccgttcaggcatggcgcaagcgctttgctgctgacgagcgaaaaggcatcgcaggtctgagcatgtggaacatagaagaattggagggcttgcgcaagctgttgatttcctggagccgcaggacgaggaatccgcaggaggttaatcgctttgagcgaggccataccagccaccagcgtctgttgacccatatccaaaacgtcaaagaggatcgcctgaagcagttaagtcacgccattgtcatgactgccttggggtatgtttacgacgagcggaaacaagagtggtgcgccgaatacccggcttgccaggtcattctgtttgaaaatctgagccagtaccgttctaacctggatcgctcgaccaaagaaaactccaccttgatgaagtgggcgcatcgcagcattccgaaatacgtccacatgcaggcggagccatacgggattcagattggcgatgtccgggcggaatattcctctcgtttttacgccaagacaggaacgccaggcattcgttgtaaaaaggtgagaggccaagacctgcagggcagacggtttgagaacttgcagaagaggttagtcaacgagcaatttttgacggaagaacaagtgaaacagctaaggcccggcgacattgtcccggatgatagcggagaactgttcatgaccttgacagacggaagcggaagcaaggaggtcgtgtttctccaggccgatattaacgcggcgcacaatctgcaaaaacgtttttggcagcgatacaatgaactgttcaaggttagctgccgcgtcatcgtccgagacgaggaagagtatctcgttcccaagacaaaatcggtgcaggcaaagctgggcaaagggctttttgtgaaaaaatcggatacagcctggaaagatgtatatgtgtgggacagccaggcaaagcttaaaggtaaaacaacctttacagaagagtctgagtcgcccgaacaactggaagactttcaggagatcatcgaggaagcagaagaggcgaaaggaacataccgtacactgttccgcgatcctagcggagtcttttttcccgaatccgtatggtatccccaaaaagatttttggggcgaggtgaaaaggaagctgtacggaaaattgcgggaacggtttttgacaaaggctcggtaagggtgtgcaaggagagtgaatggcttgtcctggatacctgtccgcatgctaaatgaaattcagtattgtgagcgactgtaccatattatgcatgtgcaggggctgtttgaggaaagcgcagacacggtcgaaggagcagcacaacacaagcgtgcagagacacatctgcgcaaaagcaaggcagcgccggaagagatgtggggggacgctccgtttagcttgcagctcggcgaccctgtgcttggcattacgggaaagctggatgccgtctgtctggaagaaggtaagcagtggattccggtagaaggaaagcattcggcgtcgccagaaggcgggcagatgttcactgtaggcgtgtattcgctggacggttctgcctggcccaacgaccaaatccaattgtgtgcgcaaggcttgctgcttcgcgcgaatggatatgaatccgattatggctacttatactaccgtggcaataaaaagaaggttcgcattcctttttcgcaggaactcatagcggctactcacgcctgcattcaaaaagctcatcagcttcgggaagccgaaattccccctccgttgcaggagtcgaaaaagtgctttcgatgctcgttaaattacgtatgcatgcctgacgagacgaattacatgttggggttgagcgcaaacatcagaaagattgtgcccagtcgtccagatggcggggtactgtatgttacagagcagggggcaaaactgggcagaagcggagaaagcttgaccatcacctgccggggcgaaaagatagacgaaatcccgatcaaagacttgattcacgtgagcttgatggggcatgtgcaatgctctacgcagcttctgcacaccttgatgaactgtggcgtccacgtcagctacttgactacgcatggcacattgacaggaataatgactccccctttatcgaaaaacattcgaacaagagccaagcagtttatcaaatttcagcacgcggagatcgcccttggaatcgcgagaagggtcgtgtatgcgaaaatttccaatcagcgcacgatgctgcgccgcaatggctcaccagataaagcagttttaaaagagttaaaagagcttagagatcgcgcgtgggaggcgccatcactggaaatagtgagaggtatcgagggacgtgcagcacagttgtacatgcagtttttccctaccatgttaaagcacccagtagtagacggtatggcgatcatgaacggtcgcaaccgtcgcccgcccaaagatccggtcaatgcgctgctctccctcggctatacgcttctttcacgggatgtttactccgcatgtgccaatgtcggactcgatccactgttcggctttttccatacgatggagccgggcagaccagctttggcactcgatctgatggaaccgttccgcgccttgattgccgatagcgtagcgatacgtaccttgaatacggaggaactcaccctcggggacttttattggggaaaagacagttgttatttgaaaaaggcaggaagacaaacgtatttcgctgcctatgaaagacggatgaacgagacgctgacgcatccgcaatttgggtataagctcagctatcgccgtatgctggagctggaagcaaggtttttggcccggtatctggatggagagctggtggaatatacgccgctcatgacaaggtaggaaatgaccatgcgacaatttgttctggtaagctatgatattgccgatcaaaaacgttggagaaaagtattcaagctgatgaaggggcaaggcgagcacgtccagtactcggtgtttctgtgccaactcaccgagattcagcaagccaagctaaaggtaagcctggcggagctggttcaccatggagaagaccaggtcatgtttgtaaaaatcggcccagtgacgagagatcaactggacaagcggatatctactgttggcagggagtttctgcctcgcgatttgaccaaatttatctattaaggaatgaagaaagctagttgtaacaaaagtggaaaaagagtaaaataaaggtgtcagtcgcacgctataggccataagtcgacttacatatccgtgcgtgtgcattatgggcccatccacaggtctattcccacggataatcacgactttccactaagctttcgaattttatgatgcgagcatcctctcaggtcaaaaaagccgggggatgctcgaactctttgtgggcgtaggctttccagagttttttaggggaagaggcagccgatggataagaggaatggcgattgaattttggcttgctcgaaaaacgggtctgtaaggcttgcggctgtaggggttgagtgggaaggagttcgaaagcttagtggaaagcttcgtggttagcaccggggagaagtcatttaataaggccactgttaaaagttcgaaagcttagtggaaagcttcgtggttagcacgctaaagtccgtctaaactactgagatcttaaatcggcgctcaaataaaaaacctcgctaatgcgaggtttcagc

SEQ ID NO: 64 - DNA, 12338 bp, Artificial Sequence
  Synthetic
gaagttatgttgataaaatggtttatgaaaacgtgagtctgtggtagtattataaacaatgatggaataaagtgttttttgcgccgcacggcatgaattcaggggttagcttggttttgtgtataaataaatgttctacatatttattttgttttttgcgccgcaaaatgcaactgaaagccgcatctagagcaccctgtagaagacagggttttgagaatagcccgacatagagggcaatagacacggggagaagtcatttaataaggccactgttaaaagttttgagaatagcccgacatagagggcaatagacttttgcttcgtcacggatggacttcacaatggcaacaacgttttgagaatagcccgacatagttatagagatgtataaatataaccgataaacattgactaatttgttgaagtcagtgtttatcggttttttgtgtaaatataggagttgttagaatgatactttttgcctaattttggaactttatgaggatataagatagacttgataaaaaggtaaaagaaaggttaaagagcatggcaggaatagtgacctgtgatgaagatgatggtagaattaaaagtgttcttaaagaaaaacaatattggataaggaaaataattcaatagataaaaaatttagggggaaaaatgaaaatatcaaaagtcgatcataccagaatggcggttgctaaaggtaatcaacacaggagagatgagattagtgggattctctataaggatccgacaaagacaggaagtatagattttgatgaacgattcaaaaaactgaattgttcggcgaagatactttatcatgtattcaatggaattgctgagggaagcaataaatacaaaaatattgttgataaagtaaataacaatttagatagggtcttatttacaggtaagagctatgatcgaaaatctatcatagacatagatactgttcttagaaatgttgagaaaattaatgcatttgatcgaatttcaacagaggaaagagaacaaataattgacgatttgttagaaatacaattgaggaaggggttaaggaaaggaaaagctggattaagagaggtattactaattggtgctggtgtaatagttagaaccgataagaagcaggaaatagctgattttctggagattttagatgaagatttcaataagacgaatcaggctaagaacataaaattgtctattgagaatcaggggttggtggtctcgcctgtatcaaggggagaggaacggatttttgatgtcagtggcgcacaaaagggaaaaagcagcaaaaaagcgcaggagaaagaggcactatctgcatttctgttagattatgctgatcttgataagaatgtcaggtttgagtatttacgtaaaattagaagactgataaatctatatttctatgtcaaaaatgatgatgttatgtctttaactgaaattccggcagaagtgaatctggaaaaagattttgatatctggagagatcacgaacaaagaaaggaagagaatggagattttgttggatgtccggacatacttttggcagatcgtgatgtgaagaaaagtaacagtaagcaggtaaaaattgcagagaggcaattaagggagtcaatacgtgaaaaaaatataaaacgatatagatttagcataaaaacgattgaaaaggatgatggaacatacttttttgcaaataagcagataagtgtattttggattcatcgcattgaaaatgctgtagaacgtatattaggatctattaatgataaaaaactgtatagattacgtttaggatatctaggagaaaaagtatggaaggacatactcaattttctcagcataaaatacattgcagtaggcaaggcagtattcaattttgcaatggatgatctgcaggagaaggatagagatatagaacccggcaagatatcagaaaatgcagtaaatggattgacttcgtttgattatgagcaaataaaggcagatgagatgctgcagagagaagttgctgttaatgtagcattcgcagcaaataatcttgctagagtaactgtagatattccgcaaaatggagaaaaagaggatatccttctttggaataaaagtgacataaaaaaatacaaaaagaattcaaagaaaggtattctgaaatctatacttcagttttttggtggtgcttcaacttggaatatgaaaatgtttgagattgcatatcatgatcagccaggtgattacgaagaaaactacctatatgacattattcagatcatttactcgctcagaaataagagctttcatttcaagacatatgatcatggggataagaattggaatagagaactgataggaaagatgattgagcatgatgctgaaagagtcatttctgttgagagggaaaagtttcattccaataacctgccgatgttttataaagacgctgatctaaagaaaatattggatctcttgtatagcgattatgcaggacgtgcatctcaggttccggcatttaacactgtcttggttcgaaagaactttccggaatttcttaggaaagatatgggctacaaggttcattttaacaatcctgaagtagagaatcagtggcacagtgcggtgtattacctatataaagagatttattacaatctatttttgagagataaagaggtaaagaatcttttttatacttcattaaaaaatataagaagtgaagtttcggacaaaaaacaaaagttagcttcagatgattttgcatccaggtgtgaagaaatagaggatagaagtcttccggaaatttgtcagataataatgacagaatacaatgcgcagaactttggtaatagaaaagttaaatctcagcgtgttattgaaaaaaataaggatattttcagacattataaaatgcttttgataaagactttagcaggtgctttttctctttatttgaagcaggaaagatttgcatttattggtaaggcaacacctataccatacgaaacaaccgatgttaagaattttttgcctgaatggaaatccggaatgtatgcatcgtttgtagaggagataaagaataatcttgatcttcaagaatggtatatcgtcggacgattccttaatgggaggatgctcaatcaattggcaggaagcctgcggtcatacatacagtatgcggaagatatagaacgtcgtgctgcagaaaataggaataagcttttctccaagcctgatgaaaagattgaagcatgtaaaaaagcggtcagagtgcttgatttgtgtataaaaatttcaactagaatatctgcggaatttactgactattttgatagtgaagatgattatgcagattatcttgaaaaatatctcaagtatcaggatgatgccattaaggaattgtcaggatcttcgtatgctgcgttggatcatttttgcaacaaggatgatctgaaatttgatatctatgtaaatgccggacagaagcctatcttacagagaaatatcgtgatggcaaagctttttggaccagataacattttgtctgaagttatggaaaaggtaacagaaagtgccatacgagaatactatgactatctgaagaaagtttcaggatatcgggtaaggggaaaatgtagtacagagaaagaacaggaagatctgctaaagttccaaagattgaaaaacgcagtagaattccgggatgttactgaatatgctgaggttattaatgagcttttaggacagttgataagttggtcatatcttagggagagggatctattatatttccagctgggattccattacatgtgtctgaaaaacaaatctttcaaaccggcagaatatgtggatattcgtagaaataatggtacgattatacataatgcgatactttaccagattgtttcgatgtatattaatggactggatttctatagttgtgataaagaagggaaaacgctcaaaccaattgaaacaggaaagggcgtaggaagtaagataggacaatttataaagtattcccagtatttatacaatgatccgtcatataagcttgagatctataatgcaggattagaagtttttgaaaacattgatgaacatgataatattacagatcttagaaagtatgtggatcattttaagtattatgcatatggtaataaaatgagcctgcttgatctgtatagtgaattcttcgatcgtttctttacatatgatatgaagtatcagaagaatgtagtgaatgtgttggagaatatccttttaaggcattttgtaattttctatccgaagtttggatcaggaaaaaaagatgttggaattagggattgtaaaaaagaaagagctcagattgaaataagtgagcagagcctcacatcggaagacttcatgtttaagcttgacgacaaagcaggagaagaagcaaagaagtttccggcaagggatgaacgttatctccagacaatagccaagttgctctattatcctaacgaaattgaggatatgaacagattcatgaagaaaggagaaacgataaataaaaaagttcagtttaatagaaaaaagaagataaccaggaaacaaaagaataattcatcaaacgaggtattgtcttcaactatgggttatttatttaagaacattaaattgtaaaaaagattcgttgtagataattgataggtaaaagctgaccggagcctttggctccggacagttgtatataagaggatattaatgactgaaaatgatttttgttggaagtcagttttttctgtggaaagcgaaatcgaatatgatgagtatgcatatggcagaagagctgtagaaggcgagaatacatatgattacattactaaggaagaaagaccggaacttaatgacgaatatgtagcgagacgttgcattttcggtaaaaaagcaggaaaaatatccaggtcggattttagtaggataagatctgcgttggatcatgcgatgataaataatacacatacagcatttgccagatttatcactgaaaatctgacgagactcaatcacaaagaacattttctgaatgtgacacgtgcatattctaaacctgattctgaaaaattgatacaaccgagatactggcagtcgcctgtagttccaaaggataaacaaatatattatagcaagaatgcgattaaaaaatggtgtggttacgaagatgatattccgcctcgttctgtgatagttcagatgtgtctattgtgggggactgatcatgaagaggcagatcatatccttcgcagttcaggatacgcggcgcttagtcctgttgtacttcgagatcttatctatatgtattatctggatcatcaggatttgcaaaaaaatgagttgatatgggaagtaaaaaagcagttggatcacttcgatttgacaaatagaaattatgatacaaatccttttgatgtagggggcagcgtaaatgatcatatctgtgaactgagcgagcatatagcgaaggctcattatatttatgagagggctaaggaaggaccattgcaaaatgtaattcgggatattttgggagatacacctgccctttattctgaaatggcatttcctcagctagcatctataaacaggtgtgcttgcaattcgctttcttcatatcaaaaaaatatttttgatactgacatagctatatatgcagatgaaaaggacacaagaggtaaatcagaccgtatccttgttgagggcgcatcttcgaaatggtatgaattgaagaaacgcgatgctaataatgtcaaaatttctgaaaagctgagtatactcaatactattcttaaatttaatagtgttttttgggaagaatgttaccttgatggaaatataaaacaatcgagcggaaagcgatctgaggcaggaaaaattctttatggtcgcgacaacggaaaagaaaatgtcggagtttcaaaattggaattggtgcggtatatgatagctgcaggtcaggaacaaaatctgggaaattacctggtgagttcaggattttggagaaaaaatcatatgctgtcatttatacaaggcaatgatatagcgcttgatgagatggatgaattggatctcttagactatattctgatatatgcatggggatttagggaaaatatcattaaaaagaacagtaatgtgaattctttggatgaaaagactagaaaagtgcagtttccgtttataaagttactcatggcaattgcaagagatatccagatacttatatgttcagcacatgaaaaaacagtcgatgagtcatctcgaaatgcagcaaagaagatagatatattgggaaattatattccttttcagattcatcttcagagaactaaaaaagatggtggaagagtggtaatggatacattgtgtgctgattggattgcggattatgaatggtacattgatcttgagaaaggaacacttggatgagcagtgatgaaaggatatttaaaaaatttttggaaaaaggatcgatttctgagcagaaaaagatgcttttagaagaaaagaaatgttcggataaactaactgcactgcttgggaattactgcataccgatagacaatatttcagagtcagacggaaaaatatatgcggtctataagcttccaaaaaatgttaaacctttgtccgaaatcattaatgatgtatccttttctgattgtacgatgagagtacgtttgcttctcataaagagaattctggaactcgtgtgtgcttttcacgaaaaaaaatggtattgtctcagtatttcaccgggaatgctcatggttgaagattttgatataccgatgggaaatgtcggaaaagtattgatatatgatttcagaaatcctgttccgttcgagtcagtaaatgaaagacataattttaacgtttcaaataaatacacttcaccggagctgctcatccattcaagatatgacgagtcgaaatctgtgagtgaaaaatcagatttgtattctgttgcaaaaattgcggaaacaataataggagattttaacagtattattgcaaatggaaatttgatactacttgcaatgcttagagtttttatcagtacagggaaaagtccggaacctgagtatcggtttgaatcgtcggaaaatatgctttcagtatttgaaaatttgatcaaagaaaattgtttttttgaaaaaaacgattatacatctatgtttcatcaggcgtatgacaatttttttgaatggcaggaatgtttgatatcaccggatcacttggataaaaatatgttcgaggcagctttatcaaatcttgaggatcagctgcttagggttgatattgataagtatagagcagagtacttctataagcttctccgagagttgtctaataaatataaaaatacaattactgatgaacaaaaggtaaggttggcaatacttggaatcagagcgaaaaataatctgggaaaaagttttgatgcattggaaatatatgagtcagtacgtgatttagaaactatgttggaggagatggcagagcttagtcctgtcattgcttcgacatatatggattgctaccgatatgcagatgcgcagaaagtggcggaagaaaacattatcaggcttcataatagtaatattcgtatggagaaaaaaagaatactgcttggaaggtcatatagttcaaaagggtgcagcatggggtttcagcatattcttggtgcggatgagtcatttgaacaggctttatatttctttaacgaaaaggacaatttttggaaagaaatatttgagagcagaaatttagaggacagcgatagacttataaagtctttacgaagcaatacgcatattacgctgtttcattacatgcaatatgcatgtgaaacaaggagaaaggaattatatggagcactttcagacaaatattttataggtaaagaatggacagaaagactcaaagcatatataagcaacaaggatatatggaaaaactattatgagatatatattctgctaaagggtatttattgcttctatccagaagtcatgtgttcgtctgcgttttatgatgaaatccaaaaaatgtacgatcttgaatttgaaaaggaaaaaatgttttacccattgagtctgatagaactgtatcttgctctgatagagataaaagttaatgggagtctgacggagaatgccgagaagttgtttaaacaggcattgacacatgacaatgaagtcaaaaaaggaaatatgaatattcagaccgccatttggtatcgaatatatgcactgtataacgatgtaaaagatgaaactgataagaataaaaggcttttaaaacggcttatgattctttgccgacgatttggttgggcggatatgtatagtgctttggagaaggatgggaagttaattgattttttgagatttgaggtatgttaaatgataacacttgcattagatgaaaatggcaaatttgaagatgctttttctaaaaaaaatgaaaaaccgataatgattgcggggataatctatgatgacaaggggaaagagtatgatgctgagaatgaacgctacaggatatccagttatctgcgagcagtatgtgacagtttgggtgcgaaataccctcaggatctacattcaaatagtaatggaaataaggcgactgttgggaaagtaaaatgtaaaattggtgaaacactaaaggaattcttgagagaaggaacctatgaaaaaaaggaattgccgacaaagaacggttatttaaataagagatctggaaaatatgtaatgtttgcagaactcaggagtagtcagggagttaaaaagcgtgttagtggttggaatgacaatgatctgactcaggatgaaaaggtcagcaatctgtaccttcatatggcagaaaatgccgttgtcagaatgctcttccataatcctatatatgaagatgtaacagatgtaaatctctattttcccacgcgaaaagttgttctgaaagatagagatagagaatacgataaacaagatttcaaaatatatggtgataaggacaagtgcgaagcagaaagcgggagattggtgcattatgatatcgtgtcatcggatttttaccgtacgataatggagaacgaatgtacaagaattaataaaaagcaattaaatgttcattatatgaacacaagcccaatttcgtactgggagaaaaatgaaaaatataatacatttttatatttggctgacatagtttgttctatgctggattattacaaaaagggttcgagtccggcagagtggatggattcttttgccgaatggggaaacaaatattttggtgatgatcagataatcttatttgggtatgatgatatagatgacaaatacatggaggctgtagatgcagtaggacagggagagtattttcatgcgctggatattatatatgatgcggaatgtagtggaagtgaatttgagaagcactacaaagattattggtttccaaagcttataaaaaagatacgaataacagcaactgtggataatttatgcagatcgatctcagatctggagagttttacatatcgaagtaatcttgatcagcagaaacttttgtggatttttgaggaaatcaaagctatcgtcgataagggagattttggaaagaaatatcatacagatcaggttatgtttgatatgtgtaatgccggtattgctgtgtacaatcatatcggagattttgggactgcaaaggaatactatgatgagtgcatgaaacacactggggatgtggatctggtaaagatacttcgtgcatcaaataaaatggtggtctttcttgacgatgcttttaggtatggtgacgcgacagaacgtgccaggaagaatgttgaataccaaaaagctttgcacgatataaagagtgagatttgtccggaaaagaaagatgaagacttgaactatgccatatcgctcagtcaatttggacaggcgcttgcgtgtgaaaaaaattctgatgcagagagtgttttcctagagtcgttgcggcatatgaggaaagggactgccaattatcagattactctttcatatttactccatttttatctggatatgggaatgacagattcttatcgagaaaaaacaaaggactattttggaagtgaaaaaccaaaggaacagctgaaagaattgctgaagttatcgggaaaggatgatagtatagttactttcaaatttgcaatgtatgtctatttacgtgcactttgggtattacaggaaccgcttactgattttatcagaacaagattagaggacatacgtgagactcttgtaaagaagaaaatgagtgaacatatggttggacatccgtgggagttgatttataaatatctggcatttcttttttatcgtgatggaaattgtgaagctgctgaaaaatatattcataaaagtgaagagtgcttggaaacacaaggactgactatagatgcgattattcataatggtaagtatgaatatgcagaattgtcaggtgacgaggagatgatggcaagagagaaagcgtactttgatgaaaaagggatagatagaaaaaatgtttgtacttttatgtatcattgatgtttaataagatttgaccgaggagtgacaggtaatcgccggtatatctggtattacctgtcattttttgatgaaataagctactttttgcctaaaaaacgaaactgttggtgttttatgatgattgtgtcaacaaaagagagcaaaagaagaggagaaaagtaatgtcaatgatttcatgtccgaattgtggtggagagatatctgaaaggtcaaagaaatgtgttcattgtggatatgtgttagtcgaagaagctaaagtagtgtgcacagaatgtggaactgaggtagagagtggcgctgctgtatgtccgaagtgcggctgtcctgtaaatgatagtgagacgcctcagaaagttgaagtgactagggtaaatgtatcttccgtaatcagcaaaaaagtcgttgtaagcatactgatcgcagtgattacaattgcaggttttttctatggagtgaagtattcgcaggaaaagaaagcaattgaagagtcagtaaagcagaaggaagactatcaaagtacgctagagcttgcttcgctaatgatgcttcaaggagcttcggatgcagaaacttgtgggaatttggttaggaaagtgtggagcaactgcatttataaggagagggatgaagaaaccgacaagtatacgtgtgatagcaggggtgcaggatggttttatgatgattttaatgatgcattaatggctctttacagtgacagcagttttggcaagaagataaatgaaatcaaaaacggtcaggaaaccgttgcggcgatgatgaaagatctgaaaaatccgccggatgagatggcagatgcctatgaggatattcaaaatttttatgtgtcctatctaacgctgacagaaatggttgtgaatccaactggaagtttgagttctttttcatctgatttttccgatgcggatacggaggtgtccaatgcctatagccggatgaagttgtatttagattaaactattgaggaaaaaatggaggtgctttaatgcgggggagaaactgtggagggtcatcaggcgacggactgctggtacttctcgtactgcttgtccttttttataaaatcatgccattcataggtttatggattttaatttttggtgatgctgaacgtaaagatctgggtatgggtatgattattgtcgggatagttctatatgtattattagaggttttttaatgtgagtttctgtggtaaactataaaagtacaagcttttgcgccgcaccgcataaatagcggatttatgaccattatttggtgaaaaaaatggtgtacacctgtgtttttttgttttgcgccgcaaaatgcgccacggaaccgcatgcagagcaccctgcaagagacagggttatgaaaacagcccgacatagagggcaatagacacggggagaagtcatttaataaggccactgttaaaagttatgaaaacagcccgacatagagggcaatagacataaagaccaaaaacaggtcatctgcatactgtgttatgaaaacagcccgatatagagggtgtgagagatatagttctcgtcacagtgcagaaaatgacctattatgtgccgaaaaacaaaatgaaaaaagaatggaaaggcgtatttaatgaaatgctgatctgttgatttgaattaacaaaaaaaggtcgccccacggatgacaaaaacatccgggggcgaccctttt

SEQ ID NO: 65 - DNA, 6098 bp, Artificial Sequence
  Synthetic
tactgtgtgcataagtcttccttagatccataggtacagcagttttatttattagccttagaaaatggaaaatagagcttataaatgatatgatatttatgaataaaatgattgcattctcgtgcaaactttaaatatattgattatatcctttacattggttgttttaattactattattaagtaggaatacgatatacctctaaatgaaagaggactaaaacccgccaaaagtatcagaaaatgttattgcagtaagagactacctctatatgaaagaggactaaaacttttaacagtggccttattaaatgacttctgtaagagactacctctatatgaaagaggactaaaacgtctaatgtggataagtataaaaacgcttatccatcatttaggtgttttatttttttgtgattatatgtacaatagaagagagaaaaaaatcattgaggtgaaaactatgagaattactaaagtagaggttgatagaaaaaaagtactaatttctagggataaaaacgggggcaagttagtttatgaaaatgaaatgcaagataatacagaacaaatcatgcatcacaaaaaaagttctttttacaaaagtgtggtaaacaaaactatttgtcgtcctgaacaaaaacaaatgaaaaaattagttcatggattattacaagaaaatagtcaagaaaaaataaaagtttcagatgtcactaaacttaatatctcaaatttcttaaatcatcgtttcaaaaaaagtttatattattttcctgaaaatagtcctgacaaaagcgaagaatacagaatagaaataaatctctcccaattgttagaagatagcttaaaaaaacagcaagggacatttatatgttgggaatcttttagcaaagacatggaattatacattaattgggcggaaaattatatttcatcaaaaacgaagctaataaaaaaatccattcgaaacaatagaattcaatctactgaatcaagaagtggacaactaatggatagatatatgaaagacattttaaataaaaacaaacctttcgatatccaatcagttagcgaaaagtaccaacttgaaaaattgactagtgctttaaaagctacttttaaagaagcgaagaaaaacgacaaagagattaactataagcttaagtccactctccaaaaccatgaaagacaaataatagaagaattgaaggaaaattccgaactgaaccaatttaatatagaaataagaaaacatcttgaaacttattttcctattaagaaaacaaacagaaaagttggagatataaggaatttagaaataggagaaatccaaaaaatagtaaatcatcggttgaaaaataaaatagttcaacgcattctccaagaagggaaattagcttcttatgagattgaatcaacagttaactctaattccttacaaaaaattaaaattgaagaagcatttgccttaaagtttatcaatgcttgtttatttgcttctaacaatttaaggaatatggtatatcctgtttgcaaaaaggatatattaatgataggtgaatttaaaaatagttttaaagaaataaaacacaaaaaattcattcgtcaatggtcgcaattcttctctcaagaaataactgttgatgacattgaattagcttcatgggggctgagaggagccattgcaccaataagaaatgaaataattcatttaaagaagcatagctggaaaaaattttttaataaccctactttcaaagtgaaaaaaagtaaaataataaatgggaaaacgaaagatgttacatctgaattcctttataaagaaactttatttaaggattatttctatagtgagttagattctgttccagaattgattattaataaaatggaaagtagcaaaattttagattattattccagtgaccagcttaaccaagtttttacaattccgaatttcgaattatctttactgacttcggccgttccctttgcacctagctttaaacgagtttatttgaaaggctttgattatcagaatcaagatgaagcacaaccggattataatcttaaattaaatatctataacgaaaaagcctttaattcggaggcatttcaggcgcaatattcattatttaaaatggtttattatcaagtctttttaccgcaattcactacaaataacgatttatttaagtcaagtgtggattttattttaacattaaacaaagaacggaaaggttacgccaaagcatttcaagatattcgaaagatgaataaagatgaaaagccctcagaatatatgagttacattcagagtcaattaatgctctatcaaaaaaagcaagaagaaaaagagaaaattaatcattttgaaaaatttataaatcaagtgtttattaaaggtttcaattcttttatagaaaagaatagattaacctatatttgccatccaaccaaaaacacagtgccagaaaatgataatatagaaatacctttccacacggatatggatgattccaatattgcattttggcttatgtgtaaattattagatgctaaacaacttagcgaattacgtaatgaaatgataaaattcagttgttccttacaatcaactgaagaaataagcacatttaccaaggcgcgagaagtgattggtttagctcttttaaatggcgaaaaaggatgtaatgattggaaagaactttttgatgataaagaagcttggaaaaagaacatgtccttatatgtttccgaggaattgcttcaatcattgccgtacacacaagaagatggtcaaacacctgtaattaatcgaagtatcgatttagtaaaaaaatacggtacagaaacaatactagagaaattattttcctcctcagatgattataaagtttcagctaaagatatcgcaaaattacatgaatatgatgtaacggagaaaatagcacagcaagagagtctacataagcaatggatagaaaagcccggtttagcccgtgactcagcatggacaaaaaaataccaaaatgtgattaatgatattagtaattaccaatgggctaagacaaaggtcgaattaacacaagtaaggcatcttcatcaattaactattgatttgctttcaaggttagcaggatatatgtctatcgctgaccgtgatttccagttttctagtaattatattttagaaagagagaactctgagtatagagttacaagttggatattattaagtgaaaataaaaataaaaataaatataacgactacgaattgtataatctaaaaaatgcctctataaaagtatcatcaaaaaatgatccccagttaaaagttgatcttaagcaattacgattaaccttagagtacttagaactttttgataaccgattgaaagaaaaacgaaataacatttcacattttaattaccttaacggacagttagggaactctattttagaattatttgacgatgctcgagatgtactttcctatgatcgtaaactaaagaatgcggtgtctaaatctttgaaagaaattttaagctctcatggaatggaagtgacatttaaaccactatatcaaaccaatcatcatttaaaaattgataaactccaacctaaaaaaatacaccacttaggtgaaaaaagtactgtttcttcaaatcaagtttctaatgaatactgtcaactagtaagaacgctattaacgatgaagtaattcttttaaagcacattaattacctctaaatgaaaagaggactaaaactgaaagaggactaaaacaccagatgtggataactatattagtggctattaaaaattcgtcgatattagagaggaaactttagatgaagatgaaatggaaattaaaagaaaatgacgttcgcaaaggggtggtggtcattgagtaaaattgacatcggagaagtaacccactttttacaaggtctaaagaaaagtaacgaaaacgcccgaaaaatgatagaagacattcaatcggctgtcaaagcctacgctgatgatacaactttaaaaggaaaagcagtggattcttcacaaagatactttgatgaaacgtatactgttatttgtaaaagtatcatagaagcattagatgaaagcgaagagagattacaacaatatattcatgattttggagatcaagtggattcttcacctaacgcacgaattgatgcggaattactacaagaagcaatgagtaggttagctgacataaagcggaagcaagaagcacttatgcaatccttatcttcttctacagcaacgctttacgaaggcaagcaacaagcgttacacactcaattcacggatgcgctggagcaagaaaaaatattggaacgctatattacttttgaacaaactcacgggaatttttttgactcatttggagaacttgtctatcgaacgggacaagcagtgcgtgaattagctaataacgtcacattcgagagccaaacaggaagctatcattttgataaaatagatgcttctagattccaaactttgcaagaaatgttgccaaaggcaaagaaaaaagcatttaattttaatgactaccaaataacatggaatggcaccacgcaccttttatggaaaaatggtaaagtggatgcagaagcaaccaaagcttataacgaggcgaaactgaatggaaagctaccaaaggaaggtaatgtagcaacacaagatgcagaactattaaaaggcattttggcttcactgaaaaacaagaaagatcctatcactggagcagatataagcagtgtgcatgtattatctatccttagcgggctcgcattctcctatacagctgggaattataagggaagaaaacttactgttccaaaaagtttcttagacaaattaaagaaaaaccgaaaatctaaagtacctaaactatctagtttatcagaaaaacaacaactaaaactcgcaaataaatacaagaaaaaatcacctattccaattccagatgatgctaaaatcaaagctcagacgaaaaaggctggttatgaacaaatatcttataaatggaaagagaatgggataacctttgaagttagatggcatactaggacaccaggtgcaccaaaggaacaaggaaatacgtttgttatagaaagaaaaattcagggtacagcagaagggaaaacaaaagttcaacaaatattggttggagataataagtgggtgagtaaaagtgagtggcaaaaggctataactgataagaaaaatggtgtaagtacctcggagcaaaataaaatgttgtctgatggacattggaaagaatagaaaggagcaaaatgatggaagattattataaaggttttgagggatatccagagatagatttttatacgtatatagatgatatgaaattgggtatagcaatgtgggaaggatactttgacaacattatgaaagaaattaatccaagtaacggaagatggacttcattagcgtattattatcatttagatgaggggtggtatgatgaaagtccttgggaaataccaagtaatacagaagcattagaattattggaaacaatccatatatctaatctagatactatcacacaagagatattacttaaattaataaatttattaaagaagaatataaatagacaagtttatattgaatactcataaaaaagatgattatgatatattatagaacaaacgaacaagccccaaatacgaggtttgttcgtttgttttcaatataattatttgccaccaagtgagatattacggttttaaatagcttatttgacgataccaaaccctgataagagaaagaagaaagagaaagctggtgtagttgttttaagtgaactagataaaaaattaatagcaaaacttgaaaaagatggtgtgaaaatatcaaaagaagatgttataggaataaaataattgccagatgatgagaaatcgtttggctggaaaaaggaaatccatccgctggatttgagcatattcttattgaacatggtgaacaatttgctaaatagggaatttcaaaagctgagttacctgattttttgatgactgctttagaaaaggaaa

SEQ ID NO: 66 - DNA, 6222 bp, Artificial Sequence
  Synthetic
attctttaaaaatatctaataatttatttactatatactctaatacatcttttaacctatctaaaacatcatcacctacaacatcccaaaaatcatctaaaaagttaaaaaaatccatctttatcaactcctatatctattttttattgtgtaattcctgagttacaaaaccattataacacgtattacacacgtagtcaatacttcaaaaaaattttttgtatatttttttgaataagtaaataaaaagagctgtgtagctctttattaaaatcaatatttttattttgttaacaaacttagacaacattaaatttagaaacctatatatatttcagtacttttcatttttaggtagtctaaatcagaaatggttttgtctaaatgatgtatgtaagttttagtccccttcgtttttagggtagtctaaatcagaagtcatttaataaggccactgttaaaagttttagtccccttcgtttttagggtagtctaaatcccatccaaattatgggataatatgttactttttattttaatatttgattatttattgtttttttactgatttagattacccctttaatttattttaccatatttttctcataatgcaaactaatattccaaaatttttgtttcttttcttatgatcttttctccgatagttatttctccagataagattttcatttttttgaattgatcttctgttagaattaatgttcttactgatgaattttctggaactatcattgacaactgattttcataggaaattattttttcttttgtgctagaacttacaatgtatactgatttttgtacctgataatatccttttcttataatttcttttctaaattttgcatattcttttttttcttttcctgtttgcattggaaaatcatacattagaatccctacataattagtactcataatcctctatccttaactcaggaatttctacttctgacatttctcctgtaaaataatttctaatattatctaaaaaataatcaatcacttgagccaattcatattttttatttttccaataaactttttgtgttaataccaataacaatttttgtcttaatgatttattcaaacttacttcttcctgttgattaaaatatacgatataatctaccattggacgaaatatttcaataatatcatctgcaaaattataattattaaattgtgaactgtgatgtattcccaaacttggatgaaatcctttagccacaatttttgaagagattaagcttctcaaaaccatatacccataatttaatgccgaatttgtcccgtcttcaccaaatctcttaaattttttcccaaaaagttcaccaaaatacattcttgcagcaattgcttcctgatgttccgcttcttttccttttaatctaatattattttcatatgcttccaacttatatgatacttcctgagattttttcaaaaactgcaataaatttctttgattttctatttttctcattacaatttttctccagatttcttcttttttatcgtcaatccagctcacttgctcattaattcttgttgttacttgaaaatgattatacagtcctaatgaatgtaaaactggctgatgtttttcattacaaattatcagtggaatattatgttctgataatcttaactgtaatattccgctaattttacatctgcaattttcaactacaattgccatgatatcatttaaagatactttatcagccttattttcatcatcttcatttatcatcacaagctggttatttaaaactgataattcattgactcttgttacatggataatattagacatttttattactcctttactctaaagctttatattcaaacataactttcacaagttcacacaattcttctgaatttctatcagtcattaattttttcttttttaaatttttcaaatgtacaattttttccgattctaaagtctgaatttctattttcttatctgctcctattttaaatgttgctacaaaaccatattcctttaatatatccactattgatttcataattgcatttttaagttttctatcataagaaagtaattttcttaaattttccagcacttctaaaagtgaaatttcagcatgcggaatatagttaaaatgtgcaatatagtttcgtatatacaaatcttttttctcttgttttaatttttttacttttttatcagaatagatgcttcttttttctacattatctttgtataattctttataaaaatttatatatttttcaacaatttgcccacttttatattttacatttttactgttatcaaaattaaatatttcttcaatataatgattttcaggaaattcacctttcaatctaaatcttaagtccctttcccagatcgaagtatatcccacaagtctgtggagtatttttaataacaagccttgcaacaagtttaattcattaaattccactttatttttcaaatgagtatatttttgtatatttccaattgctttttcatattctttataatcttcatcattaaatttttcatcttttttaggtcttgcatattttctatgtaaattttgctgcattgtataatttttttctatttcattttttttattgctgtattctttcaattcttttaaacttattttatacttcgctttatcagctattttttcaagtaaatttaacatcccatatttttttatattataaaaagctctatgctttataatattttctccatcaaaatatattttatttgtgtcaaatttcttcaattctttcctatcttttattttattttcattaaaatctaaaaattttccaatttcattcgcttctaattcaaaatcttctgttactctattattatctaaatttaaaagatttataagttcaagttcatctgaaaaagtttcttctttatttgcactctgatatttttcaagacttcccttcaaattagtcaattctttatgattaagcaattttaaaattaaataaaacatattcaaattttcagtgtattttaatatctttcctaattttatctctcttacaaattcatttatttcatgtggaatttctttattcctattatgtttttcataattttttaaaattttatcatatttttctttattatctttttttatttttattttagaaaatatatcattattatcattgttattattactttctatatattttaaattatttttattcaaataatctataaaaccttttaaaaatatttgttgtataaaatcaatgtatgtatttttttcttctttatcttgattattaatcatctccctactttgtataatagcaagatattctactggtacagttttttctatattttcaaatttttgatatttataatgtcctgttttttgatttctttgtttatttatttttattacttcattagttattttaaaaaaaactttactatttttaacaaatttattaagaaattcaccataataaatatttttcaaaagatatatttgagcatctttttcttctttatccttaggaacactccaaaaaaattttaaagtatttcttaaatcttctattttattatataatttcgtaaaagaaggaacaaaaggaatattcttatttacaaaattaaattttgtattttttaaatatttaattatcacatccttttcataataattaaatacatttgcactatttaactgcttaaatatcttcaatttcaattttttctcatttatttcattttgaaacattttttttgaaatttcagaaggagctatatttttaaatgcaaatatatctttcccttctaattccaaattaaaatgcacaatcccatgtctaatactgctaatagcttcatcaatatttgcaaaaaaatcttctatctcatttttattatccatattaaaatcataactatagaacatttttaaattttcttttacttcattttgcttgttttcattatatattttatcaacttctccagaaacatatttttcttcgcccttattattttttacagtttttcctctcattctacctgtaatatcattctcattttcagtttcaagaatatttctcaatgaaaaatatgcaaccgaagaaactccaattatatttcgtaaaaatgcttcattttgtctattcctagcaataaaatcacttgttgcaatctctccaacttgtaaataataattgtatttcccacaatttcttacataagtatccaatttatttagtaatttgttttcaattaatttttttaaattttgatattcaaatattctcttaattttatcgttacttatgttactcagtcttttatacacataatttttcaaaagctgactcatttcaatttccacaaaatgacaaaaagcatattttatatttttatcattaagttcttctttatccaaataatatttataaaacacttgtgatttttttaattcactcatatccggaattttttcaattaattcttttatattatttacattttgtatttcttcgtaaataattttagcaaaattttctttatcattttttcttccaattattttgtgatagtattctcttattttatatttttcatgtttttttgaattttctattaaaaaaaataacttctcaatatcttcttttttatacaatttatcaaatgcttcctgtacattatttatataatcattacgctttgctgattctctataataatcataaataatatttcttttgctcttccctccaactttttcaacattattttcattaattttctgataattagccttattttcttcaaatgaatattttaaagaatttatcttattcaattttgcctcaacatcttttctaaatatttctaattcttcagagttcacatcttcatttaacaatattttctttaaaactgaaaaactatttttattttttaaatcatattctgaaatatcttcttcagaataatttttatcctgtactgcatttttctctttcctattctttaaatacagaacactatcttttagatgcaatactttatttgaaaaaaacttttttaaattttctcttcttattctattttcttcttcacttgcattatcaggattttttatatatatatccagtcttatacttaaaagctctgacaatctctcactagtcctattttcttcgctcgtactttttactaattttccctcttcaatatattttttatgcgaaattccatcaacttttgtaactttcatatataaaaacctcctaatatctatattttttactcaatacctaattcttttttcaatgctttttgtaaaatttgtgaaaaattcagatttttttcctgtgccaatatatctaaccaaacaggaattgttaaagttttctttttaagtgcatttgtaacttttgccacttcatacactggatcaacagataaaatatacaaatactgattttctttcagtttcacatcctccacttttgaaggctcaggaaatttttttcttacatccaaaaaatcagccaaatgcagacccaatgtctctctcaaattggaaacagcctcctccatgctatctccaaatgtagcataataatttatctctccatcttcaaacttatcaaaatcaacaatacaaccataataagtcccatcttccttagttaccactgctggataaaatacatccattttaattatctccaatctataccacgtgttaaatacgtgtttaaaaatatttataaaattttttagcatctctgctaaaataaaacaattatttcaaatttttctattccttaatcactcattgttagtgattctttttttacttggacaatttttcatttaatttcttcaatttttttaaaatcacatttttttaatattccttatttaattgcaaattttcattacttttggggtgctctaaatcccatccaaattatgggataataatttttagtgaaagcaagaagggactagaatttaatcccaacttgtttttcaatacttcttaatgttcctacaggtatatcttttgaatatggtactgtgaccacaccttccacacctgggatcatccattgataatgactacctcttatacgcacaacttttccgcctaattttctaaatcttttttcgat

SEQ ID NO: 67 - DNA, 6337 bp, Artificial Sequence
  Synthetic
ctttctatctttttcaaataaaattaggctctagttagcctaatcgcataattatttattatagtataattcttattttttttcaacctaaaaatttaaaacatctccaaaaattttcgtttcagaacaaccaagcaaccatattcaaaaaacaataaaaaatgagcaagaattgaaattttattctcactcagaagttatttttattaaatatcacttttcgatattggggtggtctatatcaatttaaaagacagaatagataattctttagagttttagtccccttcgatattggggtggtctatatcagaagtcatttaataaggccactgttaaaagttttagtccccttcgatattggggtggtctatatcccatcctaatttcttgctgatgagatatttatttctaatttttctattttgtctttattttcaatactttcaatcctatttttctctttattaataatatagaaccaccctatactattataccatattttttgatttttcaaaattccaatattttgttttgtgaaattttttctcccattgtcacttctcctgcaagtaccttcattttttgaaactgatcttctgtcaggataatggaacggattgatgaattttctggagcgagcattgataactgtttttctgccagttcgattttttcttttgttttcgacctcattatatataccgatttttgaagctgataatatcccttttctatcaattttttcctaaaagtcctatattcaaatctctcaacatctgtctgcataggaaaatcatacataagcagaccaaaatactcaatactcatagtccatcacgctcaatgtcggaattatcacttcttcatcttttacaaaataatttcgtatactatccaaataatagtctaccgcttggaaaaaatcatatttcttattgttaaataataccttctgctgtgctacaagaagtattttttgccttatttccttacttaatttcacttcattcaaaatatccttgtacatataaacaagataatccaccataggacgaaaaacctctattatatcatcagaaaaattataggcattaaactgtgacttatgatgtaatcctaaacttggatgaaatccttttgctacaatctttgatgatattatagctcttaaaatcatatatccataattaagtgcagaattcactccatcttcatcaaatcttttaaaactattactatacaattcctgaaaatatatccttgaagctattgcttcctgatgttctgcactcgcatcatcttttttcaagttttccttatatgttttcagtctttcaatggaaatatcacttttttcaagatactctaacaatgctctttgattttcaatcttattctccactatcctgctccacaatttttcctttttctctttttcccactcaatctgctcatttattcgtaaagtcacttgaaaatgattaaataatcccagcgaatgaatttcaggctgatgtttctcgttgcaaataataatcggaatgttattttccaccagcctcaactgcaaaatcgcactaatcttacaatagcagttttcaataactatcgcagatatatcattcaaagaaatcttatttttctcatcattattgtcttcatcaaccattataagctgattattcgatattgacaaatcatcagcccttgttatgtgaattatattgggcattttaatcatactccttataaatttcattcttataacgtatcattcgtattttctatttttgttaaaagttctattatcaagtttttaatataatcagaattataactttctaattctaaaacagaaacttttttaggtttcattaatctttcaagtatatcattattaccgataagtttaaattttttctttaattcatcataatctaaattcacatcttttttaaatacttcaaatacacttgcataagttgaattattataacgtgtactatatgataataaattagaaactctatcaatttgttctgcaatactgtaatcagcaaacggatttcttacaatatagaaatgtgaaatatagtttctaatactttcattttccggcttattaatttcagaattttcagacaaatcaattccaaatccataacatattttctcaaattttttataagattcttcatcaaaaaatttatagtatgctgttgttgtataaaagccatcagatccattacgcttaggataagctctacttattccagtattgtagccacttaacttaataattcctaattctcttagcccatttacaatatagtgcatatctctttcaaatctagccatttgaatagcaagtttccaatttatatctatcaaataactttctattttattcaaataattaaattctaccaaatctctaatttttttgtattcagaaactctattataatctttttcaaatgatttatagtttttattttgtatattttttgcaaaaaagtcatcattttctttcaatttttttatatacttctctttgtattctttagaatatccatttagtttatcatttagatttttcaatattgcatcaatttcagatattttattttttctaatatttttaccatcaatattaaataaaaattttgcatcagccattttaatatcatttgaaattaatccataaattttatcaaaatttggatttccaatatttaaaaataaattctttttataaatatataattcattcttacgttctttaggataatatatttcttgaaatttattttcattctctgattccatatcttctattaaattatctatttcttttttgtatttttttaaaaaatcagaattaaatattattctacacaatattttactctttatttcctgatctttatcttttatatactgatcaaccttttttttcaaatcctttttatttatgtttgataactttctttgttcatcttgtaatatattcgattttttatctatctcaaatttagtttcatcatcaaaaattacaattttttctaattttttctctaaaacatcacaaccattaatatcatctttaaattcagttaatatattattttttatatcctcataataattattaaaaatttcttttttagtttgtattttaaaatcatcaaagtctttttctatctctttcattttttgaataaattcttctaaattaagattccaattttcagttatacattcatttctcaaagtatttaattgcattatttcatctaaaatatctataatattttgatattctgaagtatttaaccaaactgatgttgcaaaaaatctatttctaattttatttataaccgcattactatttaacagtgcaaatattgaaattatatattcaaaatcatcatttattactatagttttatcactagtctttacagttattctttcgtaagttttattatcattaatgtcttttatttgtttcttaatttcttgaatattcattttaaaatctgaaaaatcaaaaagttcctcataattttttctcaaatatccaatataacattctattacttttttctgatattttttaatagctttattattaccttttgaagcagaaatctgagcatttttataataattttctataatattttcatctatttcatcaatgtttcctaaagttttctttaattcttgtaaaaatatattcttactttcattttcttctaaatcatcttctaaaattaatttcttatacaattctttattcacatatattaaagcatttaatactattttttctgtttctatagtatcaaatggttcattcttaggattattcctatataaatttaatatttcaggaagtactttagaaaaggatggtaaatatttaatatcattattattttcttctgaaattttaatatcatttattttagtaattatattttttttatctttaaatactacatctaaatttaatgcttttgacacttcttcatctgatatttttaaattttgaattatatttatgactttattatagtcatcttgcgttccttgtaaatctctttccttgctaatcgcatgtaatatcctgtttctttcatttgttcctatctttgtaaatttcctaataaaattatttgtaatgttatttttattatctataaaatctaagtctcttattatttttatttttgaatttaaaatttttttatcaagtacgtaatttttttctcgatctcctccaaagaaatctatattttcatcattatttatattttctctagaaaaaatcttatttaattccatattggtagaagcaaaaaaagtaatcaattctaaatccaattcctctttagcgtgaagtctagaaaaatcatcagtatttactgttgtcatatctatatcattatgtcttaatttccctaaatacataatatgctctaacgtatattgcttaactctttttaaaattttttcagataatatactttcatttaaaattttttctatttctattttttccattttctttaatctgactttttgttcatttaccaatattttttcaattcttcctttcaaatatcgatatatgattttatatagttctttttcttcatcagatttctttgaaaattttttcgaatcaaaattaactttataatgttttttaaatattccaaaaatttctgtatcacaatttcctttttttagttctttttctaatttttttattaattcatctattttaaattctgctaaaattttttctattttttcttttatactattattttttatattttctacaaaaaattttacaattttatcttttttattttctctttctattttaaatttttcgtgcttatctaatagtacataagattttatatatgttctatttcttctcttttcaagaaattcattattaactttttttactttttcaattcttttagtaatattccaaaattctaactcttttataacaaaatcagctatatcttctactgttaaatctacatttatatttaaaattttttcaacaagcatttttttatttttagatttctttttatcaccaccaacattaagataaaattttacaaaacccagaatttctaaattactttttattttttctcttatttccataaaattagtcaaaataacatctattttatcatctttcaataatttttctcttaaatgttcttcataatatcgattttcaaatactttttctgtttcattttcaattattttttctataatcttatataaactcatgttaatatttttaaaaatttcgtaaattgatttttttgtttctaattcatcattttctattattcttaatattattgaacaatcatttagtgttttattagtatactcatctctgatatctatctctatttcttcttcattctcttgtctctttatttctatttttttatcatctttagttattccttgcctaattgcttcatctattattttcttttttgtaatccccaatgctttcaatttctcagattttccatatgcttctatatataatacaacttcttctgtttccaaaaaatcatcattattttctattcttatgattccttctttacctttcaacttaaatagaatatttcctgcatgaaattttcttgtaaattctttaagaatattatcattttttttgtaattaatatattttctaataaatttattattatcaattttttctttattattattttcattaatatttaaaatgtatttgtttccatcatagttccttttaacttttactttccgttttattttaaaatcttttttatcacgaacttcataccatctcttatgtccaaataaatttcccattccaatctcctcgtttctactttaatctaataaaatatttttaaattaaatcaattttacatctttctaatcaaaaatacaattttccatttttagtataccacatcaatattaaatctcaaaaaaataaggagccgtcaaacatagctccctacttctatttactcataatccccatctatccttacttttcgtaaaatcaatccttctttcgcctttagatccaacttaattttcccatttgaacctgttctaaatgttctgccttctgttaccaaatcaataaatctttcatcctgataatttgtttcaaattccacattttcccagctgttaaacgaattatttattacaacaataattaaatgatcctcgattactctttcatacacaattattt

SEQ ID NO: 68 - DNA, 173 bp, Artificial Sequence
  Synthetic
aatatggattacttggtagaacagcaatctacgccagtgaattcgagctcggtacccggggatcctctagagtcgacctgcaggcatgcaagcttggcgtaatcatggtcatagctgtttcctgtgtttatccgctcacaattccacacaacatacgagccggaagcataaag

SEQ ID NO: 69 - DNA, 173 bp, Artificial Sequence
  Synthetic
ggccagtgaattcgagctcggtacccggggatcctctagaaatatggattacttggtagaacagcaatctactcgacctgcaggcatgcaagcttggcgtaatcatggtcatagctgtttcctgtgtttatccgctcacaattccacacaacatacgagccggaagcataaag

SEQ ID NO: 70 - DNA, 56 bp, Artificial Sequence
  Synthetic
ccaccccaatatcgaaggggactaaaactagattgctgttctaccaagtaatccat

SEQ ID NO: 71 - protein, 1434 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTLKRPAATKKAGQAKKKKGSYPYDVPDYAYPYDVPDYAYPYDVPDYA

SEQ ID NO: 72 - RNA, 56 nt, Artificial Sequence
  Synthetic
ccaccccaauaucgaaggggacuaaaacuagauugcuguucuaccaaguaauccau

SEQ ID NO: 73 - RNA, 56 nt, Artificial Sequence
  Synthetic
ccaccccaauaucgaaggggacuaaaacuuucuagaggauccccggguaccgagcu

SEQ ID NO: 74 - RNA, 56 nt, Artificial Sequence
  Synthetic
ccaccccaauaucgaaggggacuaaaacaguaauccauauuucuagaggauccccg

SEQ ID NO: 75 - RNA, 56 nt, Artificial Sequence; identical to SEQ ID NO: 72
  Synthetic

SEQ ID NO: 76 - RNA, 56 nt, Artificial Sequence
  Synthetic
ccaccccaauaucgaaggggacuaaaaccaugccugcaggucgaguagauugcugu

SEQ ID NO: 77 - RNA, 56 nt, Artificial Sequence
  Synthetic
ccaccccaauaucgaaggggacuaaaacgcaugccugcaggucgaguagauugcug

SEQ ID NO: 78 - RNA, 56 nt, Artificial Sequence
  Synthetic
ccaccccaauaucgaaggggacuaaaacaagcuugcaugccugcaggucgaguaga

SEQ ID NO: 79 - RNA, 56 nt, Artificial Sequence
  Synthetic
ccaccccaauaucgaaggggacuaaaaccgccaagcuugcaugccugcaggucgag

SEQ ID NO: 80 - RNA, 56 nt, Artificial Sequence
  Synthetic
ccaccccaauaucgaaggggacuaaaacgauuacgccaagcuugcaugccugcagg

SEQ ID NO: 81 - RNA, 56 nt, Artificial Sequence
  Synthetic
ccaccccaauaucgaaggggacuaaaacugauuacgccaagcuugcaugccugcag

SEQ ID NO: 82 - RNA, 56 nt, Artificial Sequence
  Synthetic
ccaccccaauaucgaaggggacuaaaacaugaccaugauuacgccaagcuugcaug

SEQ ID NO: 83 - RNA, 56 nt, Artificial Sequence
  Synthetic
ccaccccaauaucgaaggggacuaaaacuaugaccaugauuacgccaagcuugcau

SEQ ID NO: 84 - RNA, 56 nt, Artificial Sequence
  Synthetic
ccaccccaauaucgaaggggacuaaaacagcuaugaccaugauuacgccaagcuug

SEQ ID NO: 85 - RNA, 56 nt, Artificial Sequence
  Synthetic
ccaccccaauaucgaaggggacuaaaacgaaacagcuaugaccaugauuacgccaa

SEQ ID NO: 86 - RNA, 56 nt, Artificial Sequence
  Synthetic
ccaccccaauaucgaaggggacuaaaacacaggaaacagcuaugaccaugauuacg

SEQ ID NO: 87 - RNA, 56 nt, Artificial Sequence
  Synthetic
ccaccccaauaucgaaggggacuaaaacaacacaggaaacagcuaugaccaugauu

SEQ ID NO: 88 - RNA, 56 nt, Artificial Sequence
  Synthetic
ccaccccaauaucgaaggggacuaaaacaaacacaggaaacagcuaugaccaugau

SEQ ID NO: 89 - RNA, 56 nt, Artificial Sequence
  Synthetic
ccaccccaauaucgaaggggacuaaaacauaaacacaggaaacagcuaugaccaug

SEQ ID NO: 90 - RNA, 56 nt, Artificial Sequence
  Synthetic
ccaccccaauaucgaaggggacuaaaacggauaaacacaggaaacagcuaugacca

SEQ ID NO: 91 - RNA, 56 nt, Artificial Sequence
  Synthetic
ccaccccaauaucgaaggggacuaaaacagcggauaaacacaggaaacagcuauga

SEQ ID NO: 92 - RNA, 56 nt, Artificial Sequence
  Synthetic
ccaccccaauaucgaaggggacuaaaacgagcggauaaacacaggaaacagcuaug

SEQ ID NO: 93 - RNA, 56 nt, Artificial Sequence; identical to SEQ ID NO: 72
  Synthetic

SEQ ID NO: 94 - RNA, 54 nt, Artificial Sequence
  Synthetic
accccaauaucgaaggggacuaaaacuagauugcuguucuaccaaguaauccau

SEQ ID NO: 95 - RNA, 52 nt, Artificial Sequence
  Synthetic
cccaauaucgaaggggacuaaaacuagauugcuguucuaccaaguaauccau

SEQ ID NO: 96 - RNA, 50 nt, Artificial Sequence
  Synthetic
caauaucgaaggggacuaaaacuagauugcuguucuaccaaguaauccau

SEQ ID NO: 97 - RNA, 48 nt, Artificial Sequence
  Synthetic
auaucgaaggggacuaaaacuagauugcuguucuaccaaguaauccau

SEQ ID NO: 98 - RNA, 47 nt, Artificial Sequence
  Synthetic
uaucgaaggggacuaaaacuagauugcuguucuaccaaguaauccau

SEQ ID NO: 99 - RNA, 46 nt, Artificial Sequence
  Synthetic
aucgaaggggacuaaaacuagauugcuguucuaccaaguaauccau

SEQ ID NO: 100 - RNA, 52 nt, Artificial Sequence
  Synthetic
ccaccccaauaucgaaggggacuaaaacuagauugcuguucuaccaaguaau

SEQ ID NO: 101 - RNA, 51 nt, Artificial Sequence
  Synthetic
ccaccccaauaucgaaggggacuaaaacuagauugcuguucuaccaaguaa

SEQ ID NO: 102 - RNA, 50 nt, Artificial Sequence
  Synthetic
ccaccccaauaucgaaggggacuaaaacuagauugcuguucuaccaagua

SEQ ID NO: 103 - RNA, 49 nt, Artificial Sequence
  Synthetic
ccaccccaauaucgaaggggacuaaaacuagauugcuguucuaccaagu

SEQ ID NO: 104 - RNA, 48 nt, Artificial Sequence
  Synthetic
ccaccccaauaucgaaggggacuaaaacuagauugcuguucuaccaag

SEQ ID NO: 105 - RNA, 47 nt, Artificial Sequence
  Synthetic
ccaccccaauaucgaaggggacuaaaacuagauugcuguucuaccaa

SEQ ID NO: 106 - RNA, 46 nt, Artificial Sequence
  Synthetic
ccaccccaauaucgaaggggacuaaaacuagauugcuguucuacca

SEQ ID NO: 107 - RNA, 45 nt, Artificial Sequence
  Synthetic
ccaccccaauaucgaaggggacuaaaacuagauugcuguucuacc

SEQ ID NO: 108 - RNA, 44 nt, Artificial Sequence
  Synthetic
ccaccccaauaucgaaggggacuaaaacuagauugcuguucuac

SEQ ID NO: 109 - RNA, 40 nt, Artificial Sequence
  Synthetic
ccaccccaauaucgaaggggacuaaaacuagauugcuguu

SEQ ID NO: 110 - RNA, 56 nt, Artificial Sequence
  Synthetic
ccacccgaauaucgaacgggacuaaaacuagauugcuguucuaccaaguaauccau

SEQ ID NO: 111 - RNA, 56 nt, Artificial Sequence
  Synthetic
ccaccgcaauaucgaagcggacuaaaacuagauugcuguucuaccaaguaauccau

SEQ ID NO: 112 - RNA, 56 nt, Artificial Sequence
  Synthetic
ccacgccaauaucgaaggcgacuaaaacuagauugcuguucuaccaaguaauccau

SEQ ID NO: 113 - RNA, 56 nt, Artificial Sequence
  Synthetic
ccagcccaauaucgaagggcacuaaaacuagauugcuguucuaccaaguaauccau

SEQ ID NO: 114 - RNA, 57 nt, Artificial Sequence
  Synthetic
ccagggggaauaucgaaccccacuaaaacuagauugcuguucuaccaaguaauccau

SEQ ID NO: 115 - RNA, 57 nt, Artificial Sequence
  Synthetic
ccaccaccaauaucgaaggggacuaaaacuagauugcuguucuaccaaguaauccau

SEQ ID NO: 116 - RNA, 56 nt, Artificial Sequence
  Synthetic
ccaacccaauaucgaaggggacuaaaacuagauugcuguucuaccaaguaauccau

SEQ ID NO: 117 - RNA, 56 nt, Artificial Sequence
  Synthetic
ccacccaaauaucgaaggggacuaaaacuagauugcuguucuaccaaguaauccau

SEQ ID NO: 118 - RNA, 58 nt, Artificial Sequence
  Synthetic
ccacccccaauaucgaagggggacuaaaacuagauugcuguucuaccaaguaauccau

SEQ ID NO: 119 - RNA, 55 nt, Artificial Sequence
  Synthetic
ccaccccauaucgaaggggacuaaaacuagauugcuguucuaccaaguaauccau

SEQ ID NO: 120 - RNA, 53 nt, Artificial Sequence
  Synthetic
ccaccccaucgaaggggacuaaaacuagauugcuguucuaccaaguaauccau

SEQ ID NO: 121 - RNA, 49 nt, Artificial Sequence
  Synthetic
ccaccccaaggggacuaaaacuagauugcuguucuaccaaguaauccau

SEQ ID NO: 122 - RNA, 57 nt, Artificial Sequence
  Synthetic
ccaccccaaauaucgaaggggacuaaaacuagauugcuguucuaccaaguaauccau

SEQ ID NO: 123 - RNA, 59 nt, Artificial Sequence
  Synthetic
ccaccccaaaaauaucgaaggggacuaaaacuagauugcuguucuaccaaguaauccau

SEQ ID NO: 124 - RNA, 63 nt, Artificial Sequence
  Synthetic
ccaccccaaaaaaaaauaucgaaggggacuaaaacuagauugcuguucuaccaaguaauccau

SEQ ID NO: 125 - RNA, 56 nt, Artificial Sequence
  Synthetic
ccaccccgauaucgaaggggacuaaaacuagauugcuguucuaccaaguaauccau

SEQ ID NO: 126 - RNA, 56 nt, Artificial Sequence
  Synthetic
ccaccccaaaaucgaaggggacuaaaacuagauugcuguucuaccaaguaauccau

SEQ ID NO: 127 - RNA, 56 nt, Artificial Sequence
  Synthetic
ccaccccaauauccaaggggacuaaaacuagauugcuguucuaccaaguaauccau

SEQ ID NO: 128 - RNA, 56 nt, Artificial Sequence
  Synthetic
ccaccccaauaucgaaggggacuaaaacaagauugcuguucuaccaaguaauccau

SEQ ID NO: 129 - RNA, 56 nt, Artificial Sequence
  Synthetic
ccaccccaauaucgaaggggacuaaaacuagaaugcuguucuaccaaguaauccau

SEQ ID NO: 130 - RNA, 56 nt, Artificial Sequence
  Synthetic
ccaccccaauaucgaaggggacuaaaacuagauugcaguucuaccaaguaauccau

SEQ ID NO: 131 - RNA, 56 nt, Artificial Sequence
  Synthetic
ccaccccaauaucgaaggggacuaaaacuagauugcuguuguaccaaguaauccau

SEQ ID NO: 132 - RNA, 56 nt, Artificial Sequence
  Synthetic
ccaccccaauaucgaaggggacuaaaacuagauugcuguucuacgaaguaauccau

SEQ ID NO: 133 - RNA, 56 nt, Artificial Sequence
  Synthetic
ccaccccaauaucgaaggggacuaaaacuagauugcuguucuaccaagaaauccau

SEQ ID NO: 134 - RNA, 56 nt, Artificial Sequence
  Synthetic
ccaccccaauaucgaaggggacuaaaacuagauugcuguucuaccaaguaaugcau

SEQ ID NO: 135 - RNA, 56 nt, Artificial Sequence
  Synthetic
ccaccccaauaucgaaggggacuaaaacuagauugcuguucuaccaaguaauccaa

SEQ ID NO: 136 - RNA, 56 nt, Artificial Sequence
  Synthetic
ccaccccaauaucgaaggggacuaaaacaugauugcuguucuaccaaguaauccau

SEQ ID NO: 137 - RNA, 56 nt, Artificial Sequence
  Synthetic
ccaccccaauaucgaaggggacuaaaacuagauaccuguucuaccaaguaauccau

SEQ ID NO: 138 - RNA, 56 nt, Artificial Sequence
  Synthetic
ccaccccaauaucgaaggggacuaaaacuagauugcugaacuaccaaguaauccau

SEQ ID NO: 139 - RNA, 56 nt, Artificial Sequence
  Synthetic
ccaccccaauaucgaaggggacuaaaacuagauugcuguucuaggaaguaauccau

SEQ ID NO: 140 - RNA, 56 nt, Artificial Sequence
  Synthetic
ccaccccaauaucgaaggggacuaaaacuagauugcuguucuaccaagauauccau

SEQ ID NO: 141 - RNA, 56 nt, Artificial Sequence
  Synthetic
ccaccccaauaucgaaggggacuaaaacuagauugcuguucuaccaaguaaucguu

SEQ ID NO: 142 - RNA, 173 nt, Artificial Sequence
  Synthetic
ggccagugaauucgagcucgguacccggggauccucuagaaauauggauuacuugguagaacagcaaucuacucgaccugcaggcaugcaagcuuggcguaaucauggucauagcuguuuccuguguuuauccgcucacaauuccacacaacauacgagccggaagcauaaag

SEQ ID NO: 143 - RNA, 152 nt, Artificial Sequence
  Synthetic
aauauggauuacuugguagaacagcaaucuacaaaaaaaaaaaaaaaaaaagaaaaaaaaaaaaaaaaaaagaaaaaaaaaaaaaaaaaaagaaaaaaaaaaaaaaaaaaagaaaaaaaaaaaaaaaaaaagaaaaaaaaaaaaaaaaaaag

SEQ ID NO: 144 - RNA, 152 nt, Artificial Sequence
  Synthetic
aauauggauuacuugguagaacagcaaucuacuuuuuuuuuuuuuuuuuuucuuuuuuuuuuuuuuuuuuucuuuuuuuuuuuuuuuuuuucuuuuuuuuuuuuuuuuuuucuuuuuuuuuuuuuuuuuuucuuuuuuuuuuuuuuuuuuuc

SEQ ID NO: 145 - RNA, 176 nt, Artificial Sequence
  Synthetic
ggguagguguuccacaggguagccagcagcauccugcgaugcaaauauggauuacuugguagaacagcaaucuaauccggaacauaauggugcagggcgcugacuuccgcguuuccagacuuuacgaaacacggaaaccgaagaccauucauguuguugcugccggaagcauaaag

SEQ ID NO: 146 - RNA, 176 nt, Artificial Sequence
  Synthetic
gggccccuccguucgcguuuacgcggacggugagacugaagauaauauggauuacuugguagaacagcaaucuaaacucauucucuuuaaaauaucguucgaacuggacucccggucguuuuaacucgacuggggccaaaacgaaacaguggcacuaccccgccggaagcauaaag

SEQ ID NO: 147 - RNA, 173 nt, Artificial Sequence
  Synthetic
ggccagugaauucgagcucgguacccggggauccucuagaaauauggauuacuugguagaacagcaaucuagucgaccugcaggcaugcaagcuuggcguaaucauggucauagcuguuuccuguguuuauccgcucacaauuccacacaacauacgagccggaagcauaaag

SEQ ID NO: 148 - RNA, 173 nt, Artificial Sequence
  Synthetic
ggccagugaauucgagcucgguacccggggauccucuagaaauauggauuacuugguagaacagcaaucuaaucgaccugcaggcaugcaagcuuggcguaaucauggucauagcuguuuccuguguuuauccgcucacaauuccacacaacauacgagccggaagcauaaag

SEQ ID NO: 149 - RNA, 173 nt, Artificial Sequence
  Synthetic
ggccagugaauucgagcucgguacccggggauccucuagaaauauggauuacuugguagaacagcaaucuauucgaccugcaggcaugcaagcuuggcguaaucauggucauagcuguuuccuguguuuauccgcucacaauuccacacaacauacgagccggaagcauaaag

SEQ ID NO: 150 - RNA, 175 nt, Artificial Sequence
  Synthetic
accgaucgucguuguuugggcaaugcacguucuccaacggugcuccuauggggcacaaguugcaggaugcagcgccuuacaagaaguucgcugaacaagcaaccguuaccccccgcgcucugagagcggcucuauugguccgagaccaaugugcgccguggaucagacacgcggu

SEQ ID NO: 151 - RNA, 175 nt, Artificial Sequence
  Synthetic
acuguuggugguguagagcuuccuguagccgcauggcguucguacuuaaauauggaacuaaccauuccaauuuucgcuacgaauuccgacugcgagcuuauuguuaaggcaaugcaaggucuccuaaaagauggaaacccgauucccucagcaaucgcagcaaacuccggcaucu

SEQ ID NO: 152 - RNA, 175 nt, Artificial Sequence
  Synthetic
gguaacaugcucgagggccuuacggcccccgugggaugcuccuacaugucaggaacaguuacugacguaauaacgggugaguccaucauaagcguugacgcucccuacggguggacuguggagagacagggcacugcuaaggcccaaaucucagccaugcaucgagggguacaau

SEQ ID NO: 153 - RNA, 175 nt, Artificial Sequence
  Synthetic
uucguaaaacguucguguccgggcucuuucgcgagagcugcggcgcgcacuuuuaccguggugucgaugucaaaccguuuuacaucaagaaaccuguugacaaucucuucgcccugaugcugauauuaaaucggcuacgggguuggggaguugucggagguaugucagauccacg

SEQ ID NO: 154 - RNA, 70 nt, Artificial Sequence
  Synthetic
auaggccagugaauucgagcucgaauauggauuacuugguagaacagcaaucuacgccggaagcauaaag

SEQ ID NO: 155 - RNA, 70 nt, Artificial Sequence
  Synthetic
cuuuaugcuuccggcguagauugcuguucuaccaaguaauccauauucgagcucgaauucacuggccuau

SEQ ID NO: 156 - DNA, 198 bp, Artificial Sequence
  Synthetic
ctttatgcttccggctcgtatgttgtgtggaattgtgagcggataaacacaggaaacagctatgaccatgattacgccaagcttgcatgcctgcaggtcgagaatatggattacttggtagaacagcaatctatctagaggatccccgggtaccgagctcgaattcactggccccctatagtgagtcgtattaatttc

SEQ ID NO: 157 - RNA, 28 nt, Artificial Sequence
  Synthetic
gaaguuugcagcuggauacgacagacgg

SEQ ID NO: 158 - RNA, 28 nt, Artificial Sequence
  Synthetic
ugucuggaaguuugcagcuggauacgac

SEQ ID NO: 159 - RNA, 28 nt, Artificial Sequence
  Synthetic
agcuggauacgacagacggccaucuaac

SEQ ID NO: 160 - RNA, 28 nt, Artificial Sequence
  Synthetic
uacgucgcgauauguugcacguugucug

SEQ ID NO: 161 - RNA, 31 nt, Artificial Sequence
  Synthetic
uacggacgaccuucaccuucaccuucgauuu

SEQ ID NO: 162 - RNA, 31 nt, Artificial Sequence
  Synthetic
ucguacggacgaccuucaccuucaccuucga

SEQ ID NO: 163 - RNA, 31 nt, Artificial Sequence
  Synthetic
cggucuggguaccuucguacggacgaccuuc

SEQ ID NO: 164 - RNA, 31 nt, Artificial Sequence
  Synthetic
gcggucuggguaccuucguacggacgaccuu

SEQ ID NO: 165 - RNA, 31 nt, Artificial Sequence
  Synthetic
agcggucuggguaccuucguacggacgaccu

SEQ ID NO: 166 - RNA, 31 nt, Artificial Sequence
  Synthetic
aguucauaacacguucccauuugaaaccuuc

SEQ ID NO: 167 - RNA, 31 nt, Artificial Sequence
  Synthetic
uuaacuuuguagaugaacucaccgucuugca

SEQ ID NO: 168 - RNA, 31 nt, Artificial Sequence
  Synthetic
uuuaacuuuguagaugaacucaccgucuugc

SEQ ID NO: 169 - RNA, 31 nt, Artificial Sequence
  Synthetic
guuuaacuuuguagaugaacucaccgucuug

SEQ ID NO: 170 - RNA, 28 nt, Artificial Sequence
  Synthetic
aaguuugcagcuggauacgacagacggc

SEQ ID NO: 171 - RNA, 28 nt, Artificial Sequence
  Synthetic
acaggaugucccaagcgaacggcagcgg

SEQ ID NO: 172 - RNA, 28 nt, Artificial Sequence
  Synthetic
gcuuguucagcgaacuucuuguaaggcg

SEQ ID NO: 173 - RNA, 28 nt, Artificial Sequence
  Synthetic
uaagcucgcagucggaauucguagcgaa

SEQ ID NO: 174 - RNA, 28 nt, Artificial Sequence
  Synthetic
cgucaacgcuuaugauggacucacccgu

SEQ ID NO: 175 - RNA, 28 nt, Artificial Sequence
  Synthetic
ucaacagguuucuugauguaaaacgguu

SEQ ID NO: 176 - RNA, 28 nt, Artificial Sequence
  Synthetic
aaguuugcagcuggauacgacagacggc

SEQ ID NO: 177 - RNA, 28 nt, Artificial Sequence
  Synthetic
uuugcagcuggauacgacagacggccau

SEQ ID NO: 178 - RNA, 28 nt, Artificial Sequence
  Synthetic
cagcuggauacgacagacggccaucuaa

SEQ ID NO: 179 - RNA, 28 nt, Artificial Sequence
  Synthetic
guugucuggaaguuugcagcuggauacg

SEQ ID NO: 180 - RNA, 28 nt, Artificial Sequence
  Synthetic
gcgauauguugcacguugucuggaaguu

SEQ ID NO: 181 - RNA, 28 nt, Artificial Sequence
  Synthetic
acguugucuggaaguuugcagcuggaua

SEQ ID NO: 182 - RNA, 28 nt, Artificial Sequence
  Synthetic
auguugcacguugucuggaaguuugcag

SEQ ID NO: 183 - RNA, 28 nt, Artificial Sequence
  Synthetic
ugcagcuggauacgacagacggccaucu

SEQ ID NO: 184 - RNA, 28 nt, Artificial Sequence
  Synthetic
cuggaaguuugcagcuggauacgacaga

SEQ ID NO: 185 - RNA, 28 nt, Artificial Sequence
  Synthetic
aguuugcagcuggauacgacagacggcc

SEQ ID NO: 186 - RNA, 28 nt, Artificial Sequence
  Synthetic
gcuggauacgacagacggccaucuaacu

SEQ ID NO: 187 - RNA, 28 nt, Artificial Sequence
  Synthetic
guuugcagcuggauacgacagacggcca

SEQ ID NO: 188 - RNA, 28 nt, Artificial Sequence
  Synthetic
uaguuugcagcuggauacgacagacggc

SEQ ID NO: 189 - RNA, 28 nt, Artificial Sequence
  Synthetic
aaguaugcagcuggauacgacagacggc

SEQ ID NO: 190 - RNA, 28 nt, Artificial Sequence
  Synthetic
aaguuugcugcuggauacgacagacggc

SEQ ID NO: 191 - RNA, 28 nt, Artificial Sequence
  Synthetic
aaguuugcagcucgauacgacagacggc

SEQ ID NO: 192 - RNA, 28 nt, Artificial Sequence
  Synthetic
aaguuugcagcuggauucgacagacggc

SEQ ID NO: 193 - RNA, 28 nt, Artificial Sequence
  Synthetic
aaguuugcagcuggauacgagagacggc

SEQ ID NO: 194 - RNA, 28 nt, Artificial Sequence
  Synthetic
aaguuugcagcuggauacgacagagggc

SEQ ID NO: 195 - RNA, 28 nt, Artificial Sequence
  Synthetic
uuguuugcagcuggauacgacagacggc

SEQ ID NO: 196 - RNA, 28 nt, Artificial Sequence
  Synthetic
aaguuaccagcuggauacgacagacggc

SEQ ID NO: 197 - RNA, 28 nt, Artificial Sequence
  Synthetic
aaguuugcaggaggauacgacagacggc

SEQ ID NO: 198 - RNA, 28 nt, Artificial Sequence
  Synthetic
aaguuugcagcuggaaucgacagacggc

SEQ ID NO: 199 - RNA, 28 nt, Artificial Sequence
  Synthetic
aaguuugcagcuggauacgagugacggc

SEQ ID NO: 200 - protein, 6 aa, Artificial Sequence
  Synthetic
  source (1)..(6): /note="Description of Artificial Sequence: Synthetic 6xHis tag"
HHHHHH

SEQ ID NO: 201 - protein, 5 aa, Unknown
  Synthetic
  source (1)..(5): /note="Description of Unknown: 'GGDEF' family motif peptide"
GGDEF

SEQ ID NO: 202 - protein, 18 aa, Alicyclobacillus acidoterrestris
LRVMSVDLGLRTSASISV

SEQ ID NO: 203 - protein, 22 aa, Alicyclobacillus acidoterrestris
QRTLRQLRTQLAYLRLLVRCGS

SEQ ID NO: 204 - protein, 12 aa, Alicyclobacillus acidoterrestris
CQLILLEELSEY

SEQ ID NO: 205 - protein, 16 aa, Alicyclobacillus acidoterrestris
HQIHADLNAAQNLQQR

SEQ ID NO: 206 - protein, 18 aa, Alicyclobacillus contaminans
VRVMSVDLGVRYGAAISV

SEQ ID NO: 207 - protein, 22 aa, Alicyclobacillus contaminans
KQALAAIRAEMSILRKWLRVSQ

SEQ ID NO: 208 - protein, 12 aa, Alicyclobacillus contaminans
CDLILFEDLSRY

SEQ ID NO: 209 - protein, 16 aa, Alicyclobacillus contaminans
KCVHADINAAHNLQRR

SEQ ID NO: 210 - protein, 18 aa, Desulfovibrio inopinatus
LRVLSVDLGMRTFASCSV

SEQ ID NO: 211 - protein, 22 aa, Desulfovibrio inopinatus
RAEIYALKRDIQRLKSLLRLGE

SEQ ID NO: 212 - protein, 12 aa, Desulfovibrio inopinatus
CQLILFEDLARY

SEQ ID NO: 213 - protein, 16 aa, Desulfovibrio inopinatus
CVIHADMNAAQNLQRR

SEQ ID NO: 214 - protein, 18 aa, Desulfonatronum thiodismutans
LRVLSVDLGVRSFAACSV

SEQ ID NO: 215 - protein, 22 aa, Desulfonatronum thiodismutans
MEELRSLNGDIRRLKAILRLSV

SEQ ID NO: 216 - protein, 12 aa, Desulfonatronum thiodismutans
CRLILFEDLARY

SEQ ID NO: 217 - protein, 16 aa, Desulfonatronum thiodismutans
HVIHADINAAQNLQRR

SEQ ID NO: 218 - protein, 18 aa, Tuberibacillus calidus
LRVMSVDLGQRQAAAISI

SEQ ID NO: 219 - protein, 22 aa, Tuberibacillus calidus
DQAIRDLSRKLKFLKNVLNMQK

SEQ ID NO: 220 - protein, 12 aa, Tuberibacillus calidus
CQLVLFEDLSRY

SEQ ID NO: 221 - protein, 16 aa, Tuberibacillus calidus
VITHADINAAQNLQKR

SEQ ID NO: 222 - protein, 18 aa, Bacillus thermoamylovorans
LRVMSIDLGQRQAAAASI

SEQ ID NO: 223 - protein, 22 aa, Bacillus thermoamylovorans
EDNLKLMNQKLNFLRNVLHFQQ

SEQ ID NO: 224 - protein, 12 aa, Bacillus thermoamylovorans
CQIILFEDLSNY

SEQ ID NO: 225 - protein, 16 aa, Bacillus thermoamylovorans
VTTHADINAAQNLQKR

SEQ ID NO: 226 - protein, 18 aa, Bacillus sp.
FRVMSIDLGLRAAAATSI

SEQ ID NO: 227 - protein, 22 aa, Bacillus sp.
FQLHQRVKFQIRVLAQIMRMAN

SEQ ID NO: 228 - protein, 12 aa, Bacillus sp.
CQVILFENLSQY

SEQ ID NO: 229 - protein, 16 aa, Bacillus sp.
VFLQADINAAHNLQKR

SEQ ID NO: 230 - protein, 18 aa, Methylobacterium nodulans
LRVLSIDLGVRSFATCSV

SEQ ID NO: 231 - protein, 22 aa, Methylobacterium nodulans
DAELRQLRGGLNRHRQLLRAAT

SEQ ID NO: 232 - protein, 12 aa, Methylobacterium nodulans
CHVILFEDLSRY

SEQ ID NO: 233 - protein, 16 aa, Methylobacterium nodulans
SRIHADINAAQNLQRR

SEQ ID NO: 234 - protein, 18 aa, Unknown
  Synthetic
  source (1)..(18): /note="Description of Unknown: Candidatus Methanomethylophilus alvus sequence"
LKIIGIDRGERNLIYVTM

SEQ ID NO: 235 - protein, 22 aa, Unknown
  Synthetic
  source (1)..(22): /note="Description of Unknown: Candidatus Methanomethylophilus alvus sequence"
RKALDVREYDNKEARRNWTKVE

SEQ ID NO: 236 - protein, 13 aa, Unknown
  Synthetic
  source (1)..(13): /note="Description of Unknown: Candidatus Methanomethylophilus alvus sequence"
NAIIVMEDLNHGF

SEQ ID NO: 237 - protein, 16 aa, Unknown
  Synthetic
  source (1)..(16): /note="Description of Unknown: Candidatus Methanomethylophilus alvus sequence"
LPQDSDANGAYNIALK

SEQ ID NO: 238 - protein, 18 aa, Synergistes jonesii
VNIIGIDRGERNLVYVSL

SEQ ID NO: 239 - protein, 22 aa, Synergistes jonesii
HAKLNQKEKERDTARKSWKTIG

SEQ ID NO: 240 - protein, 13 aa, Synergistes jonesii
NAVIVMEDLNIGF

SEQ ID NO: 241 - protein, 16 aa, Synergistes jonesii
LPIDADANGAYHIALK

SEQ ID NO: 242 - protein, 18 aa, Unknown
  Synthetic
  source (1)..(18): /note="Description of Unknown: Lachnospiraceae bacterium sequence"
PYVIGIDRGERNLLYIVV

SEQ ID NO: 243 - protein, 22 aa, Unknown
  Synthetic
  source (1)..(22): /note="Description of Unknown: Lachnospiraceae bacterium sequence"
HSLLDKKEKERFEARQNWTSIE

SEQ ID NO: 244 - protein, 13 aa, Unknown
  Synthetic
  source (1)..(13): /note="Description of Unknown: Lachnospiraceae bacterium sequence"
DAVIALEDLNSGF

SEQ ID NO: 245 - protein, 16 aa, Unknown
  Synthetic
  source (1)..(16): /note="Description of Unknown: Lachnospiraceae bacterium sequence"
LPKNADANGAYNIARK

SEQ ID NO: 246 - protein, 18 aa, Francisella tularensis
VHILSIDRGERHLAYYTL

SEQ ID NO: 247 - protein, 22 aa, Francisella tularensis
HDKLAAIEKDRDSARKDWKKIN

SEQ ID NO: 248 - protein, 13 aa, Francisella tularensis
NAIVVFEDLNFGF

SEQ ID NO: 249 - protein, 16 aa, Francisella tularensis
MPQDADANGAYHIGLK

SEQ ID NO: 250 - protein, 18 aa, Moraxella caprae
VNVIGIDRGERHLLYLTV

SEQ ID NO: 251 - protein, 22 aa, Moraxella caprae
HKILDKREIERLNARVGWGEIE

SEQ ID NO: 252 - protein, 13 aa, Moraxella caprae
NAIVVLEDLNFGF

SEQ ID NO: 253 - protein, 16 aa, Moraxella caprae
QPQNADANGAYHIALK

SEQ ID NO: 254 - protein, 18 aa, Unknown
  Synthetic
  source (1)..(18): /note="Description of Unknown: Lachnospiraceae bacterium sequence"
MHIIGIDRGERNLIYLCM

SEQ ID NO: 255 - protein, 22 aa, Unknown
  Synthetic
  source (1)..(22): /note="Description of Unknown: Lachnospiraceae bacterium sequence"
HQLLKTREDENKSARQSWQTIH

SEQ ID NO: 256 - protein, 13 aa, Unknown
  Synthetic
  source (1)..(13): /note="Description of Unknown: Lachnospiraceae bacterium sequence"
NAIVVLEDLNFGF

SEQ ID NO: 257 - protein, 16 aa, Unknown
  Synthetic
  source (1)..(6): /note="Description of Unknown: Lachnospiraceae bacterium sequence"
MPLDADANGAYNIARK

SEQ ID NO: 258 - protein, 18 aa, Prevotella albensis
THIIGIDRGERHLLYLSL

SEQ ID NO: 259 - protein, 22 aa, Prevotella albensis
HNLLEKREKERTEARHSWSSIE

SEQ ID NO: 260 - protein, 13 aa, Prevotella albensis
NAIVVLEDLNGGF

SEQ ID NO: 261 - protein, 16 aa, Prevotella albensis
FPENADANGAYNIARK

SEQ ID NO: 262 - protein, 18 aa, Smithella sp.
INIIGIDRGERHLLYYAL

SEQ ID NO: 263 - protein, 22 aa, Smithella sp.
HNLLDKKEGDRATARQEWGVIE

SEQ ID NO: 264 - protein, 13 aa, Smithella sp.
NAIIVMEDLNFGF

SEQ ID NO: 265 - protein, 16 aa, Smithella sp.
MPKNADANGAYHIALK

SEQ ID NO: 266 - protein, 18 aa, Porphyromonas crevioricanis
MHVIGIDRGERNLLYICV

SEQ ID NO: 267 - protein, 22 aa, Porphyromonas crevioricanis
HDLLESRDKDRQQERRNWQTIE

SEQ ID NO: 268 - protein, 13 aa, Porphyromonas crevioricanis
KAVVALEDLNMGF

SEQ ID NO: 269 - protein, 16 aa, Porphyromonas crevioricanis
LPKDADANGAYNIALK

SEQ ID NO: 270 - protein, 18 aa, Sulfolobus solfataricus
GKVVAIDVGVEKLLITSD

SEQ ID NO: 271 - protein, 23 aa, Sulfolobus solfataricus
VKHIHRELSRKKFLSNNWFKAKV

SEQ ID NO: 272 - protein, 13 aa, Sulfolobus solfataricus
YDVVVMEGIHAKQ

SEQ ID NO: 273 - protein, 16 aa, Sulfolobus solfataricus
WIADRDYNASLNILRG

SEQ ID NO: 274 - protein, 18 aa, Nostoc sp.
LKTIGLDVGLNHFLTDSE

SEQ ID NO: 275 - protein, 23 aa, Nostoc sp.
LKRLQRRLSKTKKGSNNRVKARN

SEQ ID NO: 276 - protein, 13 aa, Nostoc sp.
SDLVAYEDLQVRN

SEQ ID NO: 277 - protein, 16 aa, Nostoc sp.
HIQDRDWNAARNILEL

SEQ ID NO: 278 - protein, 18 aa, Unknown
  Synthetic
  source (1)..(18): /note="Description of Unknown: Candidatus Nitrososphaera gargensis sequence"
AKPVGIDVGIAKFCHHSD

SEQ ID NO: 279 - protein, 23 aa, Unknown
  Synthetic
  source (1)..(23): /note="Description of Unknown: Candidatus Nitrososphaera gargensis sequence"
LRRAHRRVSRRQIGSNNRKKAKR

SEQ ID NO: 280 - protein, 13 aa, Unknown
  Synthetic
  source (1)..(13): /note="Description of Unknown: Candidatus Nitrososphaera gargensis sequence"
YDLIFLERLRVMN

SEQ ID NO: 281 - protein, 16 aa, Unknown
  Synthetic
  source (1)..(16): /note="Description of Unknown: Candidatus Nitrososphaera gargensis sequence"
AILDRDYNSAINILKR

SEQ ID NO: 282 - protein, 18 aa, Helicobacter pylori
KKAVGLDMGLRTLIVTSD

SEQ ID NO: 283 - protein, 23 aa, Helicobacter pylori
LTKAQRRLSKKVKDSNNRKKQAK

SEQ ID NO: 284 - protein, 13 aa, Helicobacter pylori
YDLIGVETLNVKA

SEQ ID NO: 285 - protein, 16 aa, Helicobacter pylori
TTHHRDYNASVNIRNY

SEQ ID NO: 286 - protein, 18 aa, Flexibacter litoralis
NQAVGIDMGITFFCIDSN

SEQ ID NO: 287 - protein, 23 aa, Flexibacter litoralis
LRIANRSLSRKKKFSNGWYKKKV

SEQ ID NO: 288 - protein, 13 aa, Flexibacter litoralis
NSLVVVEDLKVKN

SEQ ID NO: 289 - protein, 16 aa, Flexibacter litoralis
HETNADENASKNILSE

SEQ ID NO: 290 - protein, 18 aa, Escherichia coli
ASMVGLDAGVAKLATLSD

SEQ ID NO: 291 - protein, 23 aa, Escherichia coli
LARLQRQLSRKVKFSNNWQKQKR

SEQ ID NO: 292 - protein, 13 aa, Escherichia coli
HAMIVIEDLKVSN

SEQ ID NO: 293 - protein, 16 aa, Escherichia coli
YTANADVNGARNILAA

SEQ ID NO: 294 - protein, 18 aa, Clostridium botulinum
NKKVGIDVGLKEFATTSD

SEQ ID NO: 295 - protein, 23 aa, Clostridium botulinum
LAKLQKDLSRKKKNSNNRKKARL

SEQ ID NO: 296 - protein, 13 aa, Clostridium botulinum
NQAIVIENLKVSN

SEQ ID NO: 297 - protein, 16 aa, Clostridium botulinum
MIMDRDLNASKNLLNL

SEQ ID NO: 298 - protein, 18 aa, Acidaminococcus sp.
MYYLGLDIGTNSVGYAVT

SEQ ID NO: 299 - protein, 22 aa, Acidaminococcus sp.
AERRSFRTSRRRLDRRQQRVKL

SEQ ID NO: 300 - protein, 13 aa, Acidaminococcus sp.
PKRIFIEMARDGE

SEQ ID NO: 301 - protein, 16 aa, Acidaminococcus sp.
LHHAKDAFLAIVTGNV

SEQ ID NO: 302 - protein, 18 aa, Coprococcus catus
EYFLGLDMGTGSLGWAVT

SEQ ID NO: 303 - protein, 22 aa, Coprococcus catus
EERRMFRTARRRLDRRNWRIQV

SEQ ID NO: 304 - protein, 13 aa, Coprococcus catus
PKRVFVEMAREKQ

SEQ ID NO: 305 - protein, 16 aa, Coprococcus catus
LHHAKDAYLNIVVGNA

SEQ ID NO: 306 - protein, 18 aa, Treponema denticola
DYFLGLDVGTGSVGWAVT

SEQ ID NO: 307 - protein, 22 aa, Treponema denticola
EVRRLHRGARRRIERRKKRIKL

SEQ ID NO: 308 - protein, 13 aa, Treponema denticola
PKKIFIEMAKGAE

SEQ ID NO: 309 - protein, 16 aa, Treponema denticola
FHHAHDAYLNIVVGNV

SEQ ID NO: 310 - protein, 18 aa, Mycoplasma mobile
KVVLGLDLGIASVGWCLT

SEQ ID NO: 311 - protein, 22 aa, Mycoplasma mobile
ETRRKKRGQRRRNRRLFTRKRD

SEQ ID NO: 312 - protein, 13 aa, Mycoplasma mobile
IEKIVVEVTRSSN

SEQ ID NO: 313 - protein, 16 aa, Mycoplasma mobile
GHHAEDAYFITIISQY

SEQ ID NO: 314 - protein, 18 aa, Streptococcus thermophilus
DLVLGLDIGIGSVGVGIL

SEQ ID NO: 315 - protein, 22 aa, Streptococcus thermophilus
LVRRTNRQGRRLTRRKKHRIVR

SEQ ID NO: 316 - protein, 13 aa, Streptococcus thermophilus
FDNIVIEMARETN

SEQ ID NO: 317 - protein, 16 aa, Streptococcus thermophilus
HHHAVDALIIAASSQL

SEQ ID NO: 318 - protein, 18 aa, Campylobacter jejuni
ARILAFDIGISSIGWAFS

SEQ ID NO: 319 - protein, 22 aa, Campylobacter jejuni
LPRRLARSARKRLARRKARLNH

SEQ ID NO: 320 - protein, 13 aa, Campylobacter jejuni
VHKINIELAREVG

SEQ ID NO: 321 - protein, 16 aa, Campylobacter jejuni
LHHAIDAVIIAYANNS

SEQ ID NO: 322 - protein, 18 aa, Clostridium perfringens
NYALGLDIGITSVGWAVI

SEQ ID NO: 323 - protein, 22 aa, Clostridium perfringens
LPRRLARGRRRLLRRKAYRVER

SEQ ID NO: 324 - protein, 13 aa, Clostridium perfringens
PVRINIELARDLA

SEQ ID NO: 325 - protein, 16 aa, Clostridium perfringens
KHHALDAAVVGVTTQG

SEQ ID NO: 326 - protein, 18 aa, Akkermansia muciniphila
SLTFSFDIGYASIGWAVI

SEQ ID NO: 327 - protein, 22 aa, Akkermansia muciniphila
FKRREYRRLRRNIRSRRVRIER

SEQ ID NO: 328 - protein, 13 aa, Akkermansia muciniphila
ISRVCVEVGKELT

SEQ ID NO: 329 - protein, 16 aa, Akkermansia muciniphila
LHHALDACVLGLIPYI

SEQ ID NO: 330 - protein, 18 aa, Bifidobacterium longum
RYRIGIDVGLNSVGLAAV

SEQ ID NO: 331 - protein, 22 aa, Bifidobacterium longum
NMSGVARRTRRMRRRKRERLHK

SEQ ID NO: 332 - protein, 13 aa, Bifidobacterium longum
PVSVNIEHVRSSF

SEQ ID NO: 333 - protein, 16 aa, Bifidobacterium longum
RHHAVDASVIAMMNTA

SEQ ID NO: 334 - protein, 18 aa, Wolinella succinogenes
VSPISVDLGGKNTGFFSF

SEQ ID NO: 335 - protein, 22 aa, Wolinella succinogenes
VGRRSKRHSKRNNLRNKLVKRL

SEQ ID NO: 336 - protein, 13 aa, Wolinella succinogenes
KVPIILEQNAFEY

SEQ ID NO: 337 - protein, 16 aa, Wolinella succinogenes
SSHAIDAVMAFVARYQ

SEQ ID NO: 338 - protein, 18 aa, Legionella pneumophila
LSPIGIDLGGKFTGVCLS

SEQ ID NO: 339 - protein, 22 aa, Legionella pneumophila
AQRRATRHRVRNKKRNQFVKRV

SEQ ID NO: 340 - protein, 13 aa, Legionella pneumophila
LIPIYLEQNRFEF

SEQ ID NO: 341 - protein, 15 aa, Legionella pneumophila
PSHAIDATLTMSIGL

SEQ ID NO: 342 - protein, 18 aa, Francisella tularensis
ILPIAIDLGVKNTGVFSA

SEQ ID NO: 343 - protein, 22 aa, Francisella tularensis
NNRTARRHQRRGIDRKQLVKRL

SEQ ID NO: 344 - protein, 13 aa, Francisella tularensis
HIPIITESNAFEF

SEQ ID NO: 345 - protein, 16 aa, Francisella tularensis
YSHLIDAMLAFCIAAD

SEQ ID NO: 346 - protein, 18 aa, Streptococcus pyogenes
KYSIGLDIGTNSVGWAVI

SEQ ID NO: 347 - protein, 22 aa, Streptococcus pyogenes
EATRLKRTARRRYTRRKNRICY

SEQ ID NO: 348 - protein, 13 aa, Streptococcus pyogenes
PENIVIEMARENQ

SEQ ID NO: 349 - protein, 16 aa, Streptococcus pyogenes
YHHAHDAYLNAVVGTA

SEQ ID NO: 350 - protein, 18 aa, Lactobacillus delbrueckii
KVSLGVDTGQRHIGFAIV

SEQ ID NO: 351 - protein, 23 aa, Lactobacillus delbrueckii
YTRKIYRRSKRNRKTRYRQARFL

SEQ ID NO: 352 - protein, 13 aa, Lactobacillus delbrueckii
NPDLHIEVGKFDM

SEQ ID NO: 353 - protein, 15 aa, Lactobacillus delbrueckii
KGHFMDAIAISGIKP

SEQ ID NO: 354 - protein, 18 aa, Methanohalobium evestigatum
PVVAGMDSGSKHIGCAAV

SEQ ID NO: 355 - protein, 23 aa, Methanohalobium evestigatum
KDRADYRRNRRSRKTRYRKPRFD

SEQ ID NO: 356 - protein, 13 aa, Methanohalobium evestigatum
VKKWIVETASFDI

SEQ ID NO: 357 - protein, 15 aa, Methanohalobium evestigatum
KTHYNDAVAICCDEN

SEQ ID NO: 358 - protein, 18 aa, Clostridium botulinum
PITLGIDSGYLNIGFSAI

SEQ ID NO: 359 - protein, 22 aa, Clostridium botulinum
KEKAMYRRQRRSRLRYRKPRFN

SEQ ID NO: 360 - protein, 13 aa, Clostridium botulinum
ITNIIIEVANFDT

SEQ ID NO: 361 - protein, 15 aa, Clostridium botulinum
KTHYNDAFCIAGSSN

SEQ ID NO: 362 - protein, 18 aa, Geobacillus thermoleovorans
PVSLGVDMGTRHVGISAT

SEQ ID NO: 363 - protein, 23 aa, Geobacillus thermoleovorans
AIRRQFRRSRRNRKTRYREARFL

SEQ ID NO: 364 - protein, 13 aa, Geobacillus thermoleovorans
VTSVTIEVAAFDT

SEQ ID NO: 365 - protein, 15 aa, Geobacillus thermoleovorans
KSHMVDARCISGNPL

SEQ ID NO: 366 - protein, 18 aa, Ammonifex degensii
SLRAKVDDGSRYVGIALV

SEQ ID NO: 367 - protein, 23 aa, Ammonifex degensii
TLRREYRRGRRYRIVRHRPCRNR

SEQ ID NO: 368 - protein, 13 aa, Ammonifex degensii
ISGVDVELVSSGV

SEQ ID NO: 369 - protein, 15 aa, Ammonifex degensii
KSHTNDALSLFLPGG

SEQ ID NO: 370 - protein, 18 aa, Polaromonas sp.
PLRIKLDPGSKTTGVALV

SEQ ID NO: 371 - protein, 22 aa, Polaromonas sp.
TARRQMRRRRRSNLRCRAPRFL

SEQ ID NO: 372 - protein, 13 aa, Polaromonas sp.
VRAISSELVRFDM

SEQ ID NO: 373 - protein, 15 aa, Polaromonas sp.
KTHALDAACVGQVRF

SEQ ID NO: 374 - protein, 18 aa, Anabaena variabilis
DLRIKLDPGAKITGIALV

SEQ ID NO: 375 - protein, 23 aa, Anabaena variabilis
ISRRQLRRTRRNRKTRYRKPRFL

SEQ ID NO: 376 - protein, 13 aa, Anabaena variabilis
ITAISTELVKFDM

SEQ ID NO: 377 - protein, 15 aa, Anabaena variabilis
KTHWLDAACVGQSTP

SEQ ID NO: 378 - protein, 18 aa, Nostoc sp.
PLRLKFDPGAKYTGIALV

SEQ ID NO: 379 - protein, 23 aa, Nostoc sp.
TSRRQLRRSRRSRKTRYRQPRFF

SEQ ID NO: 380 - protein, 13 aa, Nostoc sp.
ITAISQELVKFDT

SEQ ID NO: 381 - protein, 15 aa, Nostoc sp.
KSHWLDACCVGASTP

SEQ ID NO: 382 - protein, 18 aa, Thermus thermophilus
MVVAGIDPGITHLGLGVV

SEQ ID NO: 383 - protein, 13 aa, Thermus thermophilus
PEAVAVEEQFFYR

SEQ ID NO: 384 - protein, 15 aa, Thermus thermophilus
PSHLADALAIALTHA

SEQ ID NO: 385 - protein, 18 aa, Thermus thermophilus
MVVAGIDPGITHLGLGVV

SEQ ID NO: 386 - protein, 13 aa, Thermus thermophilus
PEAVAVEEQFFYR

SEQ ID NO: 387 - protein, 15 aa, Thermus thermophilus
PSHLADALAIALTHA

SEQ ID NO: 388 - protein, 18 aa, Campylobacter jejuni
ARILAFDIGISSIGWAFS

SEQ ID NO: 389 - protein, 22 aa, Campylobacter jejuni
LPRRLARSARKRLARRKARLNH

SEQ ID NO: 390 - protein, 13 aa, Campylobacter jejuni
VHKINIELAREVG

SEQ ID NO: 391 - protein, 16 aa, Campylobacter jejuni
LHHAIDAVIIAYANNS

SEQ ID NO: 392 - protein, 18 aa, Clostridium perfringens
NYALGLDIGITSVGWAVI

SEQ ID NO: 393 - protein, 22 aa, Clostridium perfringens
LPRRLARGRRRLLRRKAYRVER

SEQ ID NO: 394 - protein, 13 aa, Clostridium perfringens
PVRINIELARDLA

SEQ ID NO: 395 - protein, 16 aa, Clostridium perfringens
KHHALDAAVVGVTTQG

SEQ ID NO: 396 - protein, 18 aa, Akkermansia muciniphila
SLTFSFDIGYASIGWAVI

SEQ ID NO: 397 - protein, 22 aa, Akkermansia muciniphila
FKRREYRRLRRNIRSRRVRIER

SEQ ID NO: 398 - protein, 13 aa, Akkermansia muciniphila
ISRVCVEVGKELT

SEQ ID NO: 399 - protein, 16 aa, Akkermansia muciniphila
LHHALDACVLGLIPYI

SEQ ID NO: 400 - protein, 18 aa, Bifidobacterium longum
RYRIGIDVGLNSVGLAAV

SEQ ID NO: 401 - protein, 22 aa, Bifidobacterium longum
NMSGVARRTRRMRRRKRERLHK

SEQ ID NO: 402 - protein, 13 aa, Bifidobacterium longum
PVSVNIEHVRSSF

SEQ ID NO: 403 - protein, 16 aa, Bifidobacterium longum
RHHAVDASVIAMMNTA

SEQ ID NO: 404 - protein, 18 aa, Wolinella succinogenes
VSPISVDLGGKNTGFFSF

SEQ ID NO: 405 - protein, 22 aa, Wolinella succinogenes
VGRRSKRHSKRNNLRNKLVKRL

SEQ ID NO: 406 - protein, 13 aa, Wolinella succinogenes
KVPIILEQNAFEY

SEQ ID NO: 407 - protein, 16 aa, Wolinella succinogenes
SSHAIDAVMAFVARYQ

SEQ ID NO: 408 - protein, 18 aa, Legionella pneumophila
LSPIGIDLGGKFTGVCLS

SEQ ID NO: 409 - protein, 22 aa, Legionella pneumophila
AQRRATRHRVRNKKRNQFVKRV

SEQ ID NO: 410 - protein, 13 aa, Legionella pneumophila
LIPIYLEQNRFEF

SEQ ID NO: 411 - protein, 15 aa, Legionella pneumophila
PSHAIDATLTMSIGL

SEQ ID NO: 412 - protein, 18 aa, Francisella tularensis
ILPIAIDLGVKNTGVFSA

SEQ ID NO: 413 - protein, 22 aa, Francisella tularensis
NNRTARRHQRRGIDRKQLVKRL

SEQ ID NO: 414 - protein, 13 aa, Francisella tularensis
HIPIITESNAFEF

SEQ ID NO: 415 - protein, 16 aa, Francisella tularensis
YSHLIDAMLAFCIAAD

SEQ ID NO: 416 - protein, 18 aa, Streptococcus pyogenes
KYSIGLDIGTNSVGWAVI

SEQ ID NO: 417 - protein, 22 aa, Streptococcus pyogenes
EATRLKRTARRRYTRRKNRICY

SEQ ID NO: 418 - protein, 13 aa, Streptococcus pyogenes
PENIVIEMARENQ

SEQ ID NO: 419 - protein, 16 aa, Streptococcus pyogenes
YHHAHDAYLNAVVGTA

SEQ ID NO: 420 - protein, 18 aa, Unknown
  Synthetic
  source (1)..(18): /note="Description of Unknown: Candidatus Methanomethylophilus alvus sequence"
LKIIGIDRGERNLIYVTM

SEQ ID NO: 421 - protein, 22 aa, Unknown
  Synthetic
  source (1)..(22): /note="Description of Unknown: Candidatus Methanomethylophilus alvus sequence"
RKALDVREYDNKEARRNWTKVE

SEQ ID NO: 422 - protein, 13 aa, Unknown
  Synthetic
  source (1)..(13): /note="Description of Unknown: Candidatus Methanomethylophilus alvus sequence"
NAIIVMEDLNHGF

SEQ ID NO: 423 - protein, 16 aa, Unknown
  Synthetic
  source (1)..(16): /note="Description of Unknown: Candidatus Methanomethylophilus alvus sequence"
LPQDSDANGAYNIALK

SEQ ID NO: 424 - protein, 18 aa, Synergistes jonesii
VNIIGIDRGERNLVYVSL

SEQ ID NO: 425 - protein, 22 aa, Synergistes jonesii
HAKLNQKEKERDTARKSWKTIG

SEQ ID NO: 426 - protein, 13 aa, Synergistes jonesii
NAVIVMEDLNIGF

SEQ ID NO: 427 - protein, 16 aa, Synergistes jonesii
LPIDADANGAYHIALK

SEQ ID NO: 428 - protein, 18 aa, Unknown
  Synthetic
  source (1)..(18): /note="Description of Unknown: Lachnospiraceae bacterium sequence"
PYVIGIDRGERNLLYIVV

SEQ ID NO: 429 - protein, 22 aa, Unknown
  Synthetic
  source (2)..(22): /note="Description of Unknown: Lachnospiraceae bacterium sequence"
HSLLDKKEKERFEARQNWTSIE

SEQ ID NO: 430 - protein, 13 aa, Unknown
  Synthetic
  source (1)..(13): /note="Description of Unknown: Lachnospiraceae bacterium sequence"
DAVIALEDLNSGF

SEQ ID NO: 431 - protein, 16 aa, Unknown
  Synthetic
  source (1)..(16): /note="Description of Unknown: Lachnospiraceae bacterium sequence"
LPKNADANGAYNIARK

SEQ ID NO: 432 - protein, 18 aa, Francisella tularensis
VHILSIDRGERHLAYYTL

SEQ ID NO: 433 - protein, 22 aa, Francisella tularensis
HDKLAAIEKDRDSARKDWKKIN

SEQ ID NO: 434 - protein, 13 aa, Francisella tularensis
NAIVVFEDLNFGF

SEQ ID NO: 435 - protein, 16 aa, Francisella tularensis
MPQDADANGAYHIGLK

SEQ ID NO: 436 - protein, 18 aa, Moraxella caprae
VNVIGIDRGERHLLYLTV

SEQ ID NO: 437 - protein, 22 aa, Moraxella caprae
HKILDKREIERLNARVGWGEIE

SEQ ID NO: 438 - protein, 13 aa, Moraxella caprae
NAIVVLEDLNFGF

SEQ ID NO: 439 - protein, 16 aa, Moraxella caprae
QPQNADANGAYHIALK

SEQ ID NO: 440 - protein, 18 aa, Unknown
  Synthetic
  source (1)..(18): /note="Description of Unknown: Lachnospiraceae bacterium sequence"
MHIIGIDRGERNLIYLCM

SEQ ID NO: 441 - protein, 22 aa, Unknown
  Synthetic
  source (1)..(22): /note="Description of Unknown: Lachnospiraceae bacterium sequence"
HQLLKTREDENKSARQSWQTIH

SEQ ID NO: 442 - protein, 13 aa, Unknown
  Synthetic
  source (1)..(3): /note="Description of Unknown: Lachnospiraceae bacterium sequence"
NAIVVLEDLNFGF

SEQ ID NO: 443 - protein, 16 aa, Unknown
  Synthetic
  source (1)..(16): /note="Description of Unknown: Lachnospiraceae bacterium sequence"
MPLDADANGAYNIARK

SEQ ID NO: 444 - protein, 18 aa, Prevotella albensis
THIIGIDRGERHLLYLSL

SEQ ID NO: 445 - protein, 22 aa, Prevotella albensis
HNLLEKREKERTEARHSWSSIE

SEQ ID NO: 446 - protein, 13 aa, Prevotella albensis
NAIVVLEDLNGGF

SEQ ID NO: 447 - protein, 16 aa, Prevotella albensis
FPENADANGAYNIARK

SEQ ID NO: 448 - protein, 18 aa, Smithella sp.
INIIGIDRGERHLLYYAL

SEQ ID NO: 449 - protein, 22 aa, Smithella sp.
HNLLDKKEGDRATARQEWGVIE

SEQ ID NO: 450 - protein, 13 aa, Smithella sp.
NAIIVMEDLNFGF

SEQ ID NO: 451 - protein, 16 aa, Smithella sp.
MPKNADANGAYHIALK

SEQ ID NO: 452 - protein, 18 aa, Porphyromonas crevioricanis
MHVIGIDRGERNLLYICV

SEQ ID NO: 453 - protein, 22 aa, Porphyromonas crevioricanis
HDLLESRDKDRQQERRNWQTIE

SEQ ID NO: 454 - protein, 13 aa, Porphyromonas crevioricanis
KAVVALEDLNMGF

SEQ ID NO: 455 - protein, 16 aa, Porphyromonas crevioricanis
LPKDADANGAYNIALK

SEQ ID NO: 456 - protein, 18 aa, Alicyclobacillus acidoterrestris
LRVMSVDLGLRTSASISV

SEQ ID NO: 457 - protein, 22 aa, Alicyclobacillus acidoterrestris
QRTLRQLRTQLAYLRLLVRCGS

SEQ ID NO: 458 - protein, 12 aa, Alicyclobacillus acidoterrestris
CQLILLEELSEY

SEQ ID NO: 459 - protein, 16 aa, Alicyclobacillus acidoterrestris
HQIHADLNAAQNLQQR

SEQ ID NO: 460 - protein, 18 aa, Alicyclobacillus contaminans
VRVMSVDLGVRYGAAISV

SEQ ID NO: 461 - protein, 22 aa, Alicyclobacillus contaminans
KQALAAIRAEMSILRKWLRVSQ

SEQ ID NO: 462 - protein, 12 aa, Alicyclobacillus contaminans
CDLILFEDLSRY

SEQ ID NO: 463 - protein, 16 aa, Alicyclobacillus contaminans
KCVHADINAAHNLQRR

SEQ ID NO: 464 - protein, 18 aa, Desulfovibrio inopinatus
LRVLSVDLGMRTFASCSV

SEQ ID NO: 465 - protein, 22 aa, Desulfovibrio inopinatus
RAEIYALKRDIQRLKSLLRLGE

SEQ ID NO: 466 - protein, 12 aa, Desulfovibrio inopinatus
CQLILFEDLARY

SEQ ID NO: 467 - protein, 16 aa, Desulfovibrio inopinatus
CVIHADMNAAQNLQRR

SEQ ID NO: 468 - protein, 18 aa, Desulfonatronum thiodismutans
LRVLSVDLGVRSFAACSV

SEQ ID NO: 469 - protein, 22 aa, Desulfonatronum thiodismutans
MEELRSLNGDIRRLKAILRLSV

SEQ ID NO: 470 - protein, 12 aa, Desulfonatronum thiodismutans
CRLILFEDLARY

SEQ ID NO: 471 - protein, 16 aa, Desulfonatronum thiodismutans
HVIHADINAAQNLQRR

SEQ ID NO: 472 - protein, 18 aa, Tuberibacillus calidus
LRVMSVDLGQRQAAAISI

SEQ ID NO: 473 - protein, 22 aa, Tuberibacillus calidus
DQAIRDLSRKLKFLKNVLNMQK

SEQ ID NO: 474 - protein, 12 aa, Tuberibacillus calidus
CQLVLFEDLSRY

SEQ ID NO: 475 - protein, 16 aa, Tuberibacillus calidus
VITHADINAAQNLQKR

SEQ ID NO: 476 - protein, 18 aa, Bacillus thermoamylovorans
LRVMSIDLGQRQAAAASI

SEQ ID NO: 477 - protein, 22 aa, Bacillus thermoamylovorans
EDNLKLMNQKLNFLRNVLHFQQ

SEQ ID NO: 478 - protein, 12 aa, Bacillus thermoamylovorans
CQIILFEDLSNY

SEQ ID NO: 479 - protein, 16 aa, Bacillus thermoamylovorans
VTTHADINAAQNLQKR

SEQ ID NO: 480 - protein, 18 aa, Bacillus sp.
FRVMSIDLGLRAAAATSI

SEQ ID NO: 481 - protein, 22 aa, Bacillus sp.
FQLHQRVKFQIRVLAQIMRMAN

SEQ ID NO: 482 - protein, 12 aa, Bacillus sp.
CQVILFENLSQY

SEQ ID NO: 483 - protein, 16 aa, Bacillus sp.
VFLQADINAAHNLQKR

SEQ ID NO: 484 - protein, 18 aa, Methylobacterium nodulans
LRVLSIDLGVRSFATCSV

SEQ ID NO: 485 - protein, 22 aa, Methylobacterium nodulans
DAELRQLRGGLNRHRQLLRAAT

SEQ ID NO: 486 - protein, 12 aa, Methylobacterium nodulans
CHVILFEDLSRY

SEQ ID NO: 487 - protein, 16 aa, Methylobacterium nodulans
SRIHADINAAQNLQRR

SEQ ID NO: 488 - protein, 18 aa, Unknown
  Synthetic
  source (1)..(18): /note="Description of Unknown: Gut metagenome sequence"
KNIVSIDQGEAGFAYAVF

SEQ ID NO: 489 - protein, 22 aa, Unknown
  Synthetic
  source (1)..(22): /note="Description of Unknown: Gut metagenome sequence"
HSVKKYRGKKQRIQNFNQKFDS

SEQ ID NO: 490 - protein, 13 aa, Unknown
  Synthetic
  source (1)..(13): /note="Description of Unknown: Gut metagenome sequence"
NAFPILEKQVGNL

SEQ ID NO: 491 - protein, 16 aa, Unknown
  Synthetic
  source (1)..(16): /note="Description of Unknown: Gut metagenome sequence"
KEQHADVNAAINIGRR

SEQ ID NO: 492 - protein, 18 aa, Unknown
  Synthetic
  source (1)..(18): /note="Description of Unknown: Marine metagenome sequence"
DHIVAIDLGERSVGFAVF

SEQ ID NO: 493 - protein, 22 aa, Unknown
  Synthetic
  source (1)..(22): /note="Description of Unknown: Marine metagenome sequence"
KAVRSHRRRRQPNQKVNQTYST

SEQ ID NO: 494 - protein, 13 aa, Unknown
  Synthetic
  source (1)..(13): /note="Description of Unknown: Marine metagenome sequence"
NAFPVLEFQIKNF

SEQ ID NO: 495 - protein, 16 aa, Unknown
  Synthetic
  source (1)..(16): /note="Description of Unknown: Marine metagenome sequence"
WTGHADENAAINIGRR

SEQ ID NO: 496 - protein, 18 aa, Unknown
  Synthetic
  source (1)..(18): /note="Description of Unknown: Metagenome sequence"
DRIVAIDLGERKIGYAIF

SEQ ID NO: 497 - protein, 22 aa, Unknown
  Synthetic
  source (1)..(22): /note="Description of Unknown: Metagenome sequence"
KAVQTHRNRRQPNYRIDQTYSK

SEQ ID NO: 498 - protein, 13 aa, Unknown
  Synthetic
  source (1)..(13): /note="Description of Unknown: Metagenome sequence"
GGFPVLESSVRNF

SEQ ID NO: 499 - protein, 16 aa, Unknown
  Synthetic
  source (1)..(16): /note="Description of Unknown: Metagenome sequence"
HECHADENAAINIGRK

SEQ ID NO: 500 - protein, 18 aa, Unknown
  Synthetic
  source (1)..(18): /note="Description of Unknown: Marine metagenome sequence"
DHLLAIDLGEKRVGYAVY

SEQ ID NO: 501 - protein, 22 aa, Unknown
  Synthetic
  source (1)..(22): /note="Description of Unknown: Marine metagenome sequence"
KAVRSHRQQRQPNQKVNQTYST

SEQ ID NO: 502 - protein, 13 aa, Unknown
  Synthetic
  source (1)..(13): /note="Description of Unknown: Marine metagenome sequence"
NAFPVLESSVMNF

SEQ ID NO: 503 - protein, 16 aa, Unknown
  Synthetic
  source (1)..(16): /note="Description of Unknown: Marine metagenome sequence"
FTGHADENAAINIGWK

SEQ ID NO: 504 - protein, 15 aa, Homo sapiens
IPDWIVDLRHELTHK

SEQ ID NO: 505 - protein, 15 aa, Homo sapiens
IPDWIVDLRHELTHK

SEQ ID NO: 506 - protein, 15 aa, Mycobacterium tuberculosis
LGRFESRVRNTAAHE

SEQ ID NO: 507 - protein, 15 aa, Mycobacterium tuberculosis
LGRFESRVRNTAAHE

SEQ ID NO: 508 - protein, 15 aa, Lactococcus lactis
WIRAGWRIRNRSAHY

SEQ ID NO: 509 - protein, 15 aa, Lactococcus lactis
WIRAGWFIRNRSAHY

SEQ ID NO: 510 - protein, 15 aa, Thermus thermophilus
  MOD_RES (5)..(5): Any amino acid
LALGXVDDRSLTVHT

SEQ ID NO: 511 - protein, 15 aa, Thermus thermophilus
  MOD_RES (5)..(5): Any amino acid
LALGXVDDRSLTVHT

SEQ ID NO: 512 - protein, 22 aa, Unknown
  Synthetic
  source (1)..(22): /note="Description of Unknown: Lachnospiraceae bacterium sequence"
LKSMLYSMRNSSFHFSTENVDN

SEQ ID NO: 513 - protein, 14 aa, Unknown
  Synthetic
  source (1)..(14): /note="Description of Unknown: Lachnospiraceae bacterium sequence"
FRNEIDHFHYFYDR

SEQ ID NO: 514 - protein, 22 aa, Unknown
  Synthetic
  source (1)..(22): /note="Description of Unknown: Lachnospiraceae bacterium sequence"
LKDVIYSMRNDSFHYATENHNN

SEQ ID NO: 515 - protein, 14 aa, Unknown
  Synthetic
  source (1)..(14): /note="Description of Unknown: Lachnospiraceae bacterium sequence"
LRNYIEHFRYYSSF

SEQ ID NO: 516 - protein, 22 aa, Clostridium aminophilum
LRKAIYSLRNETFHFTTLNKGS

SEQ ID NO: 517 - protein, 14 aa, Clostridium aminophilum
VRKYVDHFKYYATS

SEQ ID NO: 518 - protein, 22 aa, Unknown
  Synthetic
  source (1)..(22): /note="Description of Unknown: Lachnospiraceae bacterium sequence"
IIQIIYSLRNKSFHFKTYDHGD

SEQ ID NO: 519 - protein, 14 aa, Unknown
  Synthetic
  source (1)..(14): /note="Description of Unknown: Lachnospiraceae bacterium sequence"
LRKYVDHFKYYAYG

SEQ ID NO: 520 - protein, 22 aa, Carnobacterium gallinarum
LRGSVQQIRNEIFHSFDKNQKF

SEQ ID NO: 521 - protein, 14 aa, Carnobacterium gallinarum
IRNQTAHLSVLQLE

SEQ ID NO: 522 - protein, 21 aa, Carnobacterium gallinarum
IRGAVQRVRNQIFHQQINKRH

SEQ ID NO: 523 - protein, 14 aa, Carnobacterium gallinarum
IRNNIAHLHVLRND

SEQ ID NO: 524 - protein, 20 aa, Paludibacter propionicigenes
IRGAVQQIRNNVNHYKKDAL

SEQ ID NO: 525 - protein, 14 aa, Paludibacter propionicigenes
IRNHIAHFNYLTKD

SEQ ID NO: 526 - protein, 20 aa, Listeria seeligeri
LRGAIAPIRNEIIHLKKHSW

SEQ ID NO: 527 - protein, 14 aa, Listeria seeligeri
KRNNISHFNYLNGQ

SEQ ID NO: 528 - protein, 20 aa, Listeria weihenstephanensis
IRGSIQQIRNEVYHCKKHSW

SEQ ID NO: 529 - protein, 14 aa, Listeria weihenstephanensis
ARNHIAHLNYLSLK

SEQ ID NO: 530 - protein, 20 aa, Listeria newyorkens
IRGSIQQIRNEVYHCKKHSW

SEQ ID NO: 531 - protein, 14 aa, Listeria newyorkens
ARNHIAHLNYLSLK

SEQ ID NO: 532 - protein, 21 aa, Leptotrichia wadei
ISYSIYNVRNGVGHFNKLILG

SEQ ID NO: 533 - protein, 14 aa, Leptotrichia wadei
FRNYIAHFLHLHTK

SEQ ID NO: 534 - protein, 21 aa, Leptotrichia wadei
MLNAITSIRHRVVHYNMNTNS

SEQ ID NO: 535 - protein, 14 aa, Leptotrichia wadei
IRNYIAHFNYIPDA

SEQ ID NO: 536 - protein, 21 aa, Leptotrichia wadei
IDEAISSIRHGIVHFNLELEG

SEQ ID NO: 537 - protein, 14 aa, Leptotrichia wadei
IRNYIAHFNYIPHA

SEQ ID NO: 538 - protein, 22 aa, Rhodobacter capsulatus
LLRYLRGCRNQTFHLGARAGFL

SEQ ID NO: 539 - protein, 21 aa, Leptotrichia buccalis
IDEAISSIRHGIVHFNLELEG

SEQ ID NO: 540 - protein, 14 aa, Rhodobacter capsulatus
TRKDLAHFNVLDRA

SEQ ID NO: 541 - protein, 21 aa, Leptotrichia sp.
IDEAISSIRHGIVHFNLELEG

SEQ ID NO: 542 - protein, 14 aa, Leptotrichia buccalis
IRNYIAHFNYIPHA

SEQ ID NO: 543 - protein, 16 aa, Leptotrichia sp.
FQKEGYLLRNKILHNS

SEQ ID NO: 544 - protein, 14 aa, Leptotrichia sp.
IRNYIAHFNYIPNA

SEQ ID NO: 545 - protein, 15 aa, Leptotrichia shahii
FTKIGTNERNRILHA

SEQ ID NO: 546 - protein, 14 aa, Leptotrichia sp.
IRNYISHFYIVRNP

SEQ ID NO: 547 - protein, 14 aa, Leptotrichia shahii
IRNYISHFYIVRNP

SEQ ID NO: 548 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 549 - protein, 872 aa, Alicyclobacillus contaminans
MGFNTAELLRKVEEEMRKTSVGFDTDNPFAHRITRRAIRGWDRIAEAWRRLPPDAPESEYIEAFKDIQRKNPRKIGSEPLFKNLAAPGVRSELLNNPQVLITFAKYNELQRQLAKAKQFAQKTLPHPVFHPVWVRYDKLGGNLHHYQIEPAVHANDTHKVKFSSLLLPQEDGSYAEVKDVTVSLAPSLQFPTGLVHPKVTTPPRTGLVTVMDEEAGKPVVCYRDRGHDALVPVAFGGAKLQFNRAHLSAGYRKGVLSAGGGGSIYFNVTLDVQVPNERDVSKTFSFSRDRDLVSLKAEELKRYMETKPLGMPGVRVMSVDLGVRYGAAISVFEVKPFAEVRKDKLHYPITGCEGFVAEHERSVILKLPGEGVRTAGKQSERKQALAAIRAEMSILRKWLRVSQVTEEDRAKAVRGLLEDERGGGWTMDPGEDSDHQPLQQFLHEARLAVGELVNLVHLSPAEWERAVIERHRRLERITASHIRVFQTMRKVWGKRRNEDAAHTGGISLAHIEHLIQQRKLFIRWSTHARTYGEVRRLPKHEGFAKRLQKHTNHVKEDRIKKLADMIVMAARGYRFLDKRARWVKTRHAPCDLILFEDLSRYRFTMDRPPTENSQLMNWSHRELLKTVKMQAALFGIGVGTVPAAFTSRFDAQTGAPGLRCKRVTKQDKEKTPFWLIQFAEITGVNVTNVEPGQLIPVDGGEWFVSPKGPRAADGLKCVHADINAAHNLQRRFWIPRLPSVKCRRYVEAEGFAAVPSSTAFMKVHGKGAFVSVDGEFYEYQKGRRVAVNRADRTSSTLDEDEGDIGEEMLVSSNGAGEFVRMFYDESGYVGYGRWMDSKVFWGKVRQIVHRAIQDQVEKRAAARGENGATSSR

SEQ ID NO: 550 - protein, 1149 aa, Desulfovibrio inopinatus
MPTRTINLKLVLGKNPENATLRRALFSTHRLVNQATKRIEEFLLLCRGEAYRTVDNEGKEAEIPRHAVQEEALAFAKAAQRHNGCISTYEDQEILDVLRQLYERLVPSVNENNEAGDAQAANAWVSPLMSAESEGGLSVYDKVLDPPPVWMKLKEEKAPGWEAASQIWIQSDEGQSLLNKPGSPPRWIRKLRSGQPWQDDFVSDQKKKQDELTKGNAPLIKQLKEMGLLPLVNPFFRHLLDPEGKGVSPWDRLAVRAAVAHFISWESWNHRTRAEYNSLKLRRDEFEAASDEFKDDFTLLRQYEAKRHSTLKSIALADDSNPYRIGVRSLRAWNRVREEWIDKGATEEQRVTILSKLQTQLRGKFGDPDLFNWLAQDRHVHLWSPRDSVTPLVRINAVDKVLRRRKPYALMTFAHPRFHPRWILYEAPGGSNLRQYALDCTENALHITLPLLVDDAHGTWIEKKIRVPLAPSGQIQDLTLEKLEKKKNRLYYRSGFQQFAGLAGGAEVLFHRPYMEHDERSEESLLERPGAVWFKLTLDVATQAPPNWLDGKGRVRTPPEVHHFKTALSNKSKHTRTLQPGLRVLSVDLGMRTFASCSVFELIEGKPETGRAFPVADERSMDSPNKLWAKHERSFKLTLPGETPSRKEEEERSIARAEIYALKRDIQRLKSLLRLGEEDNDNRRDALLEQFFKGWGEEDVVPGQAFPRSLFQGLGAAPFRSTPELWRQHCQTYYDKAEACLAKHISDWRKRTRPRPTSREMWYKTRSYHGGKSIWMLEYLDAVRKLLLSWSLRGRTYGAINRQDTARFGSLASRLLHHINSLKEDRIKTGADSIVQAARGYIPLPHGKGWEQRYEPCQLILFEDLARYRFRVDRPRRENSQLMQWNHRAIVAETTMQAELYGQIVENTAAGFSSRFHAATGAPGVRCRFLLERDFDNDLPKPYLLRELSWMLGNTKVESEEEKLRLLSEKIRPGSLVPWDGGEQFATLHPKRQTLCVIHADMNAAQNLQRRFFGRCGEAFRLVCQPHGDDVLRLASTPGARLLGALQQLENGQGAFELVRDMGSTSQMNRFVMKSLGKKKIKPLQDNNGDDELEDVLSVLPEEDDTGRITVFRDSSGIFFPCNVWIPAKQFWPAVRAMIWKVMASHSLG

SEQ ID NO: 551 - protein, 1194 aa, Desulfonatronum thiodismutans
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 552 - protein, 1388 aa, Unknown; identical to SEQ ID NO: 29
  Synthetic
  source (1)..(1388): /note="Description of Unknown: Opitutaceae bacterium sequence"

SEQ ID NO: 553 - protein, 1132 aa, Tuberibacillus calidus
MATKSFILKMKTKNNPQLRLSLWKTHELFNFGVAYYMDLLSLFRQKDLYMHNDEDPDHPVVLKKEEIQERLWMKVRETQQKNGFHGEVSKDEVLETLRALYEELVPSAVGKSGEANQISNKYLYPLTDPASQSGKGTANSGRKPRWKKLKEAGDPSWKDAYEKWEKERQEDPKLKILAALQSFGLIPLFRPFTENDHKAVISVKWMPKSKNQSVRKFDKDMFNQAIERFLSWESWNEKVAEDYEKTVSIYESLQKELKGISTKAFEIMERVEKAYEAHLREITFSNSTYRIGNRAIRGWTEIVKKWMKLDPSAPQGNYLDVVKDYQRRHPRESGDFKLFELLSRPENQAAWREYPEFLPLYVKYRHAEQRMKTAKKQATFTLCDPIRHPLWVRYEERSGTNLNKYRLIMNEKEKVVQFDRLICLNADGHYEEQEDVTVPLAPSQQFDDQIKFSSEDTGKGKHNFSYYHKGINYELKGTLGGARIQFDREHLLRRQGVKAGNVGRIFLNVTLNIEPMQPFSRSGNLQTSVGKALKVYVDGYPKVVNFKPKELTEHIKESEKNTLTLGVESLPTGLRVMSVDLGQRQAAAISIFEVVSEKPDDNKLFYPVKDTDLFAVHRTSFNIKLPGEKRTERRMLEQQKRDQAIRDLSRKLKFLKNVLNMQKLEKTDEREKRVNRWIKDREREEENPVYVQEFEMISKVLYSPHSVWVDQLKSIHRKLEEQLGKEISKWRQSISQGRQGVYGISLKNIEDIEKTRRLLFRWSMRPENPGEVKQLQPGERFAIDQQNHLNHLKDDRIKKLANQIVMTALGYRYDGKRKKWIAKHPACQLVLFEDLSRYAFYDERSRLENRNLMRWSRREIPKQVAQIGGLYGLLVGEVGAQYSSRFHAKSGAPGIRCRVVKEHELYITEGGQKVRNQKFLDSLVENNIIEPDDARRLEPGDLIRDQGGDKFATLDERGELVITHADINAAQNLQKRFWTRTHGLYRIRCESREIKDAVVLVPSDKDQKEKMENLFGIGYLQPFKQENDVYKWVKGEKIKGKKTSSQSDDKELVSEILQEASVMADELKGNRKTLFRDPSGYVFPKDRWYTGGRYFGTLEHLLKRKLAERRLFDGGSSRRGLFNGTDSNTNVE

SEQ ID NO: 554 - protein, 1108 aa, Bacillus thermoamylovorans; identical to SEQ ID NO: 32

SEQ ID NO: 555 - protein, 864 aa, Brevibacillus sp.
MPKILRGHKWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFSVEESSDKNAADFSYWIEGTPLVAVHHRSYMLRLPGEQVEKQVMEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRSRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 556 - protein, 1108 aa, Bacillus sp.; identical to SEQ ID NO: 35

SEQ ID NO: 557 - protein, 1489 aa, Desulfatirhabdium butyrativorans
MPLSNNPPVTQRAYTLRLRGADPSDLSWREALWHTHEAVNKGAKVFGDWLLTLRGGLDHTLADTKVKGGKGKPDRDPTPEERKARRILLALSWLSVESKLGAPSSYIVASGDEPAKDRNDNVVSALEEILQSRKVAKSEIDDWKRDCSASLSAAIRDDAVWVNRSKVFDEAVKSVGSSLTREEAWDMLERFFGSRDAYLTPMKDPEDKSSETEQEDKAKDLVQKAGQWLSSRYGTSEGADFCRMSDIYGKIAAWADNASQGGSSTVDDLVSELRQHFDTKESKATNGLDWIIGLSSYTGHTPNPVHELLRQNTSLNKSHLDDLKKKANTRAESCKSKIGSKGQRPYSDAILNDVESVCGFTYRVDKDGQPVSVADYSKYDVDYKWGTARHYIFAVMLDHAARRISLAHKWIKRAEAERHKFEEDAKRIANVPARAREWLDSFCKERSVTSGAVEPYRIRRRAVDGWKEVVAAWSKSDCKSTEDRIAAARALQDDSEIDKFGDIQLFEALAEDDALCVWHKDGEATNEPDFQPLIDYSLAIEAEFKKRQFKVPAYRHPDELLHPVFCDFGKSRWKINYDVHKNVQAPFYRGLCLTLWTGSEIKPVPLCWQSKRLTRDLALGNNHRNDAASAVTRADRLGRAASNVTKSDMVNITGLFEQADWNGRLQAPRQQLEAIAVVRDNPRLSEQERNLRMCGMIEHIRWLVTFSVKLQPQGPWCAYAEQHGLNTNPQYWPHADTNRDRKVHARLILPRLPGLRVLSVDLGHRYAAACAVWEAVNTETVKEACQNVGRDMPKEHDLYLHIKVKKQGIGKQTEVDKTTIYRRIGADTLPDGRPHPAPWARLDRQFLIKLQGEEKDAREASNEEIWALHQMECKLDRTKPLIDRLIASGWGLLKRQMARLDALKELGWIPAPDSSENLSREDGEAKDYRESLAVDDLMFSAVRTLRLALQRHGNRARIAYYLISEVKIRPGGIQEKLDENGRIDLLQDALALWHELFSSPGWRDEAAKQLWDSRIATLAGYKAPEENGDNVSDVAYRKKQQVYREQLRNVAKTLSGDVITCKELSDAWKERWEDEDQRWKKLLRWFKDWVLPSGTQANNATIRNVGGLSLSRLATITEFRRKVQVGFFTRLRPDGTRHEIGEQFGQKTLDALELLREQRVKQLASRIAEAALGIGSEGGKGWDGGKRPRQRINDSRFAPCHAVVIENLANYRPDETRTRLENRRLMTWSASKVHKYLSEACQLNGLYLCTVSAWYTSRQDSRTGAPGIRCQDVSVREFMQSPFWRKQVKQAEAKHDENKGDARERFLCELNKTWKAKTPAEWKKAGFVRIPLRGGEIFVSADSKSPSAKGIHADLNAAANIGLRALTDPDWPGKWWYVPCDPVSFESKMDYVKGCAAVKVGQPLRQPAQTNADGAASKIRKGKKNRTAGTSKEKVYLWRDISAFPLESNEIGEWKETSAYQNDVQYRVIRMLKEHIKSLDNRTGDNVEG

SEQ ID NO: 558 - protein, 277 aa, Alicyclobacillus herbarius
MLKQAVLGNGPLINWEKNVKRGKGMATKSIKVKLRLGKHPDIRAGIWQLHKAANAGVRYYTEWLSLMRQKNLYTRGPKGEQQLYRSGEQCRRELLQRLRERQRLNGRTDEPGTDEELLKVARQIYEVLVPQSIGKSGDAQQLASNFLSPLVDPNSKGGQGQSNAGRKPAWQKMRDEGNPGWVAAKERYEQRKATDPTKKMIEMLDGLGLKPLFSVFTETYTTGVKWKDLSKRQGVRTWDRDMFQSLSERSGVIDVGSHTVHHIDLATASDAQIQYEL

SEQ ID NO: 559 - protein, 277 aa, Alicyclobacillus contaminans
MSVKSIKFKLMIGGPQYTRIRRGIYKTHEVFNEGVRYYQEWLLLMRQGDVYRYQDDKPEIVLSAEHCKRELLRRLRQVQKENVGRTSHTDEELLQVMRALYELIVPSAVGKKGDAASLSRKFLSPLAWKDSKGLTGESKAGNKPRWKRLQEQGLPYEEEYNRWLREKESDPAKHIPAQLASMGLKPFLKVFTESTEGIAWLPLAKDQGVRTWDRDMFQQAIEGLLSWESWNRRVREEYDALSARVYAYHAKHFADQPGWAVYWPQSQPRQKGWVKMK

SEQ ID NO: 560 - protein, 218 aa, Citrobacter freundii
MYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKTSRTGKSAAFTLTLSLISNLCKK

SEQ ID NO: 561 - protein, 218 aa, Citrobacter freundii
LYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKTSRTGKSAAFTLTLSLISNLCKK

SEQ ID NO: 562 - protein, 482 aa, Brevibacillus agri
MEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRTRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 563 - protein, 584 aa, Brevibacillus agri
MAIRSIKLKLKTHTGPEAQNLRKGIWRTHRLLNEGVAYYMKMLLLFRQESTGERPKEELQEELICHIREQQQRNQADKNTQALPLDKALEALRQLYELLVPSSVGQSGDAQIISRKFLSPLVDPNSEGGKGTSKAGAKPTWQKKKEANDPTWEQDYEKWKKRREEDPTASVITTLEEYGIRPIFPLYTNTVTDIAWLPLQSNQFVRTWDRDMLQQAIERLLSWESWNKRVQEEYAKLKEKMAQLNEQLEGGQEWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFL

SEQ ID NO: 564 - protein, 259 aa, Brevibacillus sp.
MAIRSIKLKLKTHTGPEAQNLRKGIWRTHRLLNEGVAYYMKMLLLFRQESTGERPKEELQEELICHIREQQQRNQADKNTQALPLDKALEALRQLYELLVPSSVGQSGDAQIISRKFLSPLVDPNSEGGKGTSKAGAKPTWQKKKEANDPTWEQDYEKWKKRREEDPTASVITTLEEYGIRPIFPLYTNTVTDIAWLPLQSNQFVRTWDRDMLQQAIERLLSWESWNKRVQEEYAKLKEKMAQLNEQLEGGQEWCTLSR

SEQ ID NO: 565 - protein, 658 aa, Methylobacterium nodulans
MLTKQDKQQKITYCTNMNEVFEAKLGSADLLLNWDHLRGRIRDRVDAGDIGSAFLKLALDVAHVLPDGVDDQLARAAFHFQSAKGAKSKHADSVQAGLRVLSIDLGVRSFATCSVFELKDTAPTTGVAFPLAEFRLWAVHERSFTLELPGENVGAAGQQWRAQADAELRQLRGGLNRHRQLLRAATVQKGERDAYLTDLREAWSAKELWPFEASLLSELERCSTVADPLWQDTCKRAARLYRTEFGAVVSEWRSRTRSREDRKYAGKSMWSVQHLTDVRRFLQSWSLAGRASGDIRRLDRERGGVFAKDLLDHIDALKDDRLKTGADLIVQAARGFQRNEFGYWVQKHAPCHVILFEDLSRYRMRTDRPRRENSQLMQWAHRGVPDMVGMQGEIYGIQDRRDPDSARKHARQPLAAFCLDTPAAFSSRYHASTMTPGIRCHPLRKREFEDQGFLELLKRENEGLDLNGYKPGDLVPLPGGEVFVCLNANGLSRIHADINAAQNLQRRFWTQHGDAFRLPCGKSAVQGQIRWAPLSMGKRQAGALGGFGYLEPTGHDSGSCQWRKTTEAEWRRLSGAQKDRDEAAAAEDEELQGLEEELLERSGERVVFFRDPSGVVLPTDLWFPSAAFWSIVRAKTVGRLRSHLDAQAEASYAVAAGL

SEQ ID NO: 566 - protein, 464 aa, Methylobacterium nodulans
MPVRSLKLKIVVPRHPSELEKAQALWSTHRLVNEAVSFYEQKLLLLRGETYSTSDGSVPQDEVRRQLLEQAREAQARNGGSGGSDDEIVRLCRSLYEAIVLADDANAQLANAFLGPLTDPNSAGFLEAFNKVDRPAPSWLDQVPASDPIDPAVLAEANAWLDTDAGRAWLVDTGAPPRWRSLAAKQDPIWPREFARKLGELRKEAASGTSAIIKALKRDFGVLPLFQPSLAPRILGSRSSLTPWDRLAFRLAVGHLLSWESWCTRARDEHTARVQRLEQFSSAHLKGDLATKVSTLREYERARKEQIAQLGLPMGERDFLITVRMTRGWDDLREKWRRSGDKGQEALHAIIATEQTRKRGRFGDPDLFRWLARPENHHVWADGHADAVGVLARVNAMERLVERSRDTALMTLPDPVAHPRSAQWEAEGGSNLRNYQLEAVGGELQITLPLLKAADDGRCIDTPL

SEQ ID NO: 567 - protein, 370 aa, Methylobacterium nodulans
MYEAIVLADDANAQLANAFLGPLTDPNSAGFLEAFNKVDRPAPSWLDQVPASDPIDPAVLAEANAWLDTDAGRAWLVDTGAPPRWRSLAAKQDPIWPREFARKLGELRKEAASGTSAIIKALKRDFGVLPLFQPSLAPRILGSRSSLTPWDRLAFRLAVGHLLSWESWCTRARDEHTARVQRLEQFSSAHLKGDLATKVSTLREYERARKEQIAQLGLPMGERDFLITVRMTRGWDDLREKWRRSGDKGQEALHAIIATEQTRKRGRFGDPDLFRWLARPENHHVWADGHADAVGVLARVNAMERLVERSRDTALMTLPDPVAHPRSAQWEAEGGSNLRNYQLEAVGGELQITLPLLKAADDGRCIDTPL

SEQ ID NO: 568 - protein, 1050 aa, Unknown
  Synthetic
  source (1)..(1050): /note="Description of Unknown: Marine metagenome sequence"
MRSNYHGGRNARQWRKQISGLARRTKETVFTYKFPLETDAAEIDFDKAVQTYGIAEGVGHGSLIGLVCAFHLSGFRLFSKAGEAMAFRNRSRYPTDAFAEKLSAIMGIQLPTLSPEGLDLIFQSPPRSRDGIAPVWSENEVRNRLYTNWTGRGPANKPDEHLLEIAGEIAKQVFPKFGGWDDLASDPDKALAAADKYFQSQGDFPSIASLPAAIMLSPANSTVDFEGDYIAIDPAAETLLHQAVSRCAARLGRERPDLDQNKGPFVSSLQDALVSSQNNGLSWLFGVGFQHWKEKSPKELIDEYKVPADQHGAVTQVKSFVDAIPLNPLFDTTHYGEFRASVAGKVRSWVANYWKRLLDLKSLLATTEFTLPESISDPKAVSLFSGLLVDPQGLKKVADSLPARLVSAEEAIDRLMGVGIPTAADIAQVERVADEIGAFIGQVQQFNNQVKQKLENLQDADDEEFLKGLKIELPSGDKEPPAINRISGGAPDAAAEISELEEKLQRLLDARSEHFQTISEWAEENAVTLDPIAAMVELERLRLAERGATGDPEEYALRLLLQRIGRLANRVSPVSAGSIRELLKPVFMEEREFNLFFHNRLGSLYRSPYSTSRHQPFSIDVGKAKAIDWIAGLDQISSDIEKALSGAGEALGDQLRDWINLAGFAISQRLRGLPDTVPNALAQVRCPDDVRIPPLLAMLLEEDDIARDVCLKAFNLYVSAINGCLFGALREGFIVRTRFQRIGTDQIHYVPKDKAWEYPDRLNTAKGPINAAVSSDWIEKDGAVIKPVETVRNLSSTGFAGAGVSEYLVQAPHDWYTPLDLRDVAHLVTGLPVEKNITKLKRLTNRTAFRMVGASSFKTHLDSVLLSDKIKLGDFTIIIDQHYRQSVTYGGKVKISYEPERLQVEAAVPVVDTRDRTVPEPDTLFDHIVAIDLGERSVGFAVFDIKSCLRTGEVKPIHDNNGNPVVGTVAVPSIRRLMKAVRSHRRRRQPNQKVNQTYSTALQNYRENVIGDVCNRIDTLMERYNAFPVLEFQIKNFQAGAKQLEIVYGS

SEQ ID NO: 569 - protein, 1222 aa, Unknown
  Synthetic
  source (1)..(1222): /note="Description of Unknown: Gut metagenome sequence"
MKKFELKQNFRNNYSGKTLRNFRQTLAQIANKKSSDSILTIKFKLDCSKTGKLPKYENLISLYDTIEDIKKGTLSYYLFTLIVSGFKFFGSASQAKAFSTKDIFKDNDFYNQFKIQSHLDLPDFVPSKIYQRLKKNVRSTNGKDNAFKASVIVAEYRKEIGKLKNKDESSEHQCEELFKKIGTALETRFSSWQDLINNCSTGCEIIDEILNDSFGTLPSIKKMVLASTTQSSDGEQDGIAIAYDPDSTFIKSDELLNPYFAVATILKSMPPEIQQDKKSAYVKANLTTPTHNALSWIFGKGLTLFQTESTEKLCAMFNVSDKRVIEQVQDAAKAVKLPAELDLNHCTLKFQDFRSSLGGHLDSWTTNYLKRLDELNDLLLNLPKNLSLPDIFMIDGKDFIEYSGCNRDEIQQMIDFVVNEQNRIKLQESLNALLGKGNNQICSDDISTVKDFSEIVNSLHSFVQQIDNSLEQSSNEANSIFSELKKKIEKNEKWDIWKNNLKKIPKLNKLSGGVPDAWKEIREIEQKFHEISENQKKHFTEVMEWIDAGNGTIDIFESRFKYDELLKKSKKNNLQSADELAFRSVLNKLGRFARQGNDLVCEKIKNWFKEQNIFDSSKDFNRYFINQKGFIFKHPSSKKDNSPYNLSANLLEKRYEVTNTVGALLEQCESDPAIVNDPFSMRSLVEFRALWFSINISGISKEQHIPTKIAQPKLDDSTYQESVSPTLKYRLEKEQITSSELNSIFTVYKSLLSGLSIRLSRNSFYLRTKFSWIGNNSLIYCPKETTWKIPAAYFKSDLWNEYKDKQILIVNEEYDVDVVKTFESVYKIVKSKDNNEKNRILPLLKQLPHDWMFKLPFGASNAEKCKVLKLEKNNKKFKPLSVSKDSLARLSGPSTYFNQIDEIMMNDESELSEMTLLADEPVRQQMSNGKIEIIPDDYVMSLAIPITRSLKKGNTESFPFKNIVSIDQGEAGFAYAVFKLSDCGNERAEPIATGLIPIPSIRRLIHSVKKYRGKKQRIQNFNQKFDSTMFTLRENVTGDICGLIVALMKKYNAFPILEKQVGNLESGSKQLMLVYKAVNSKFLAAKVDMQNDQRRSWWYQGNSWNTPILRISNPNQSNNKNIVKNINGKKYEELKIYPGYSVSAYMTSCICHVCGRNALELLKNDDSTGKVKKYQINQDGEVTIGGEVIKLYRKPDRLTPVKNLAKKGNRERTYASINERAP

SEQ ID NO: 570 - protein, 1255 aa, Unknown
  Synthetic
  source (1)..(1255): /note="Description of Unknown: Marine metagenome sequence"
MRSNYHGGRNARQWRKQISGLARRTKETVFTYKFPLETDAAEIDFDKAVQTYGIAEGVGHGSLIGLVCAFHLSGFRLFSKAGEAMAFRNRSRYPTDAFAEKLSAIMGIQLPTLSPEGLDLIFQSPPRSRDGIAPVWSENEVRNRLYTNWTGRGPANKPDEHLLEIAGEIAKQVFPKFGGWDDLASDPDKALAAADKYFQSQGDFPSIASLPAAIMLSPANSTVDFEGDYIAIDPAAETLLHQAVSRCAARLGRERPDLDQNKGPFVSSLQDALVSSQNNGLSWLFGVGFQHWKEKSPKELIDEYKVPADQHGAVTQVKSFVDAIPLNPLFDTTHYGEFRASVAGKVRSWVANYWKRLLDLKSLLATTEFTLPESISDPKAVSLFSGLLVDPQGLKKVADSLPARLVSAEEAIDRLMGVGIPTAADIAQVERVADEIGAFIGQVQQFNNQVKQKLENLQDADDEEFLKGLKIELPSGDKEPPAINRISGGAPDAAAEISELEEKLQRLLDARSEHFQTISEWAEENAVTLDPIAAMVELERLRLAERGATGDPEEYALRLLLQRIGRLANRVSPVSAGSIRELLKPVFMEEREFNLFFHNRLGSLYRSPYSTSRHQPFSIDVGKAKAIDWIAGLDQISSDIEKALSGAGEALGDQLRDWINLAGFAISQRLRGLPDTVPNALAQVRCPDDVRIPPLLAMLLEEDDIARDVCLKAFNLYVSAINGCLFGALREGFIVRTRFQRIGTDQIHYVPKDKAWEYPDRLNTAKGPINAAVSSDWIEKDGAVIKPVETVRNLSSTGFAGAGVSEYLVQAPHDWYTPLDLRDVAHLVTGLPVEKNITKLKRLTNRTAFRMVGASSFKTHLDSVLLSDKIKLGDFTIIIDQHYRQSVTYGGKVKISYEPERLQVEAAVPVVDTRDRTVPEPDTLFDHIVAIDLGERSVGFAVFDIKSCLRTGEVKPIHDNNGNPVVGTVAVPSIRRLMKAVRSHRRRRQPNQKVNQTYSTALQNYRENVIGDVCNRIDTLMERYNAFPVLEFQIKNFQAGAKQLEIVYGSVLHRYTFSGVDAHKAKRREYWYNGELWEHPYLMAKKWNEETNSMSGAPKPVSLFPGVTVNAARTSQICHQCQRNPMSHLRGLTGTIEISSDGLLELDDGTIRLFETSDYDEDKFKQSRREKRRLDANVLLSGRHRAEYIYTVAKRNLRRPPKNVMTKDTTQSRYTCLYKNCSWTGHADENAAINIGRRYLAERIDMPASKTKAAV

SEQ ID NO: 571 - protein, 1258 aa, Unknown
  Synthetic
  source (1)..(1258): /note="Description of Unknown: Metagenome sequence"
MNARDWRKHVGVLAQQHKETTRTYTFPLDTTGSAIDFDAALQAYNAVEGVGYGSLLGLACAVHLSGFRLFSTGKEAATFRNRARYPNAAFQAALRKELGTTITTLTPETLDRLFSSRPKRRNGVPLPWNQDSIRDRLYTNWVKPRPGDTPDAVLFQIATGIAQEITEDVSSWTDLAKNSDRGLKAAHRYFARVGGFPAFDNLTPPATVQPTDTTIDYDPNAPFHLVSHADQTLIHQSISLCAHRIRQEDPALDPNKSGFIKQLQNNFLSQTFYGLSWLFGAGYVHFRECTANDLAIQYGIPNNCRDGIHQIKSFADAILPNTFFEKKHYRKDSRSVGKKAKSWISNYWQRLLQLQTWVDDHTWVTLPQELTEAQFKPLFRGLLVDAVELMAIAERLPQRLADCRDSLDCLMGKGPQAATKNDVEIVEKVREEIESFVGQIEQLGNQLRHQLENENNDQVHRDNLHQLKNRLPLDLRRPQALNKISGGVPDVAKSIRGLETQLDQVLKERRSHFGRLTKWAKECGITLDPLQPLIESEKQRVAERGSAHDAKELAIRLLLQRIGRLGHRLSPTNATAIQELLRPVFAVKREFNLFFHNHMGALYRSPYSTSRHQPFQINVDVAHGTDWIGTIETLIQNLFTQIQDDALLRDLVQLEGFVFSHKLRALPGVIPSELARPNNLQQMGLPALLLVLLQADQVHRETVLRVFNLYGSAINGYLFQALRPGFIVRAGFQRLETKKLRYVPKAQSWQYPDRLHHAKSAIKNSLSAGWIKKNHQGAILPQKTLTALVKQKSLKDTGVPEYLVQAPHDWYVPIDLRGPAIPIEGLTVGTEGPELTQLGPMKDDCAFRAIGPSSFKSKIDAGLLPQDVKYGDMTLIFDQHYQQSISFANGTFSIQYQPTSLQVKAAIPVVDKRPRDTRNNSHLYDRIVAIDLGERKIGYAIFDLKQVLKSEQLEPMREDGKPLIGSISIRSIRGLMKAVQTHRNRRQPNYRIDQTYSKALMHYRESVIGDVCNAIDTLCARYGGFPVLESSVRNFEVGSAQLKTVYGSVSRRYTWSAVDAHKNQRQQYWLGGTKDKIPIWTHPYLMTREWDEKNSKWSNRSKPLKMHPGVEVHPAGTSQICHQCKRNPIGALWNVADTVVLDDQGQLDLDDGTIRLNSGYIDTTEIKRARRKKIRLPENKPLTGSHKTSHVRAVARRNLRQPPKSTRAKDTTQSRYTCLYVDCGHECHADENAAINIGRKYLQERIHIEASRQALSTR

SEQ ID NO: 572 - protein, 1269 aa, Unknown
  Synthetic
  source (1)..(1269): /note="Description of Unknown: Marine metagenome sequence"
MVAGLKKIKRDGVTMKSNYHGGVKARAWRKRIGGLARRQKETVFTYKFPLETEEAGIDFDKAVQTYGIAEGISQGSLIGLVCAFHLSGFRLFSKADETKAFCNQGRYPNQAFAEKLRNELSVTLPKLSPQSLDVLFQSSPKSKNGVAPEWSKNAIRNRLYTNWTGKGAGTNPDEHLLEIAEDIAAEIDSDLDGWKDLEEHPEKGLSAADRYFQAQGDFPSLTGLPPSVPLTPQNSTVAFEGDPVCLNPSDNTLLHQAVARCAGRILQEQPNLSPDKNRFINQLQDELVSSQNNGLSWLFGVGFKYWKEMSVDQLADDYKVKSTDLDALKQVKSFIDAIPLNPLFDTPHYGEFRASVAGKMRSWVKNYWKRLLDLKSQLGTANINLPEGLDEQRAENLFSGLLIDSKGLRQVTDKLPSRLKKAEDTIDRLMGDGNPTSDDIEQVETVAAEISAFIGQVEQFNNQLEQRLENPLEGDDETFLKQLKIDLPAEFKKPPAINRISGGSPDPTAEIAELEEKLDRLMSARKEHYETIAEWASANKVTLDPMEAMTTLEAQRLTERGAEGDQEEFALRLLLQRIGRLANRLSPQGATAIRDLLRPVFTEKREFNLFFHNRMGSLYRSPYSTSRHQPFTIDVAVAKNTDWMDALDGIAETIMKGLSQAGDELSLRLRDWINISGFSLSQRLRGLPDTVPGELALVRSADDVRIPPMLALQLEEDEVSREVCLKAFNLYVSAINGCLFRALREGFIVRTKFQRLERDVLSYVPKTKLWNYPQRLDTARGPIHSALAAAWINKEGSVIDPVETVTALSDTGFSDDGIPEYLVQAPHDWYTPIDLRDISKPVSGLPVKKNITGLKRQKKQTAFRMVGPSSFKSHLDSTLLSEEVKLGDFTLIFDQYYKQRVSYNGRVKITFEPDRLHVEAAVPVIDKRVRPSTEEDALFDHLLAIDLGEKRVGYAVYDIKACLRTGDIKPLEDGDGKPIVGSVAVPSIRRLMKAVRSHRQQRQPNQKVNQTYSTALMNYRENVIGDVCNRIDTLMEKYNAFPVLESSVMNFEAGSRQLEMVYGSVLHRYTYSKIDAHTAKRKEYWYTGEYWDHPYLMAHKWNERTRSYSGSLSALTLYPGVMVHPAGTSQRCHQCKRNPMVEIKQLTGQVEINADGSLELDDGTICLYEGYDYSPEEYKKAKREKRRLDPNVPLSGRHQAKHVSAVAKRNLRRPTVSMMSGDTTQARYVCLYTDCDFTGHADENAAINIGWKYLTERIALSESKDKAGV

SEQ ID NO: 573 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 574 - protein, 1340 aa, Unknown
  Synthetic
  source (1)..(1340): /note="Description of Unknown: Lachnospiraceae bacterium sequence"
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 575 - protein, 1437 aa, Unknown
  Synthetic
  source (1)..(1437): /note="Description of Unknown: Lachnospiraceae bacterium sequence"
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 576 - protein, 1385 aa, Clostridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 577 - protein, 1334 aa, Unknown; identical to SEQ ID NO: 38
  Synthetic
  source (1)..(1334): /note="Description of Unknown: Lachnospiraceae bacterium sequence"

SEQ ID NO: 578 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 579 - protein, 1164 aa, Carnobacterium gallinarum
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 580 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 581 - protein, 1120 aa, Listeria seeligeri; identical to SEQ ID NO: 41

SEQ ID NO: 582 - protein, 970 aa, Listeria weihenstephanensis
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 583 - protein, 1051 aa, Listeria newyorkensis
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 584 - protein, 1182 aa, Leptotrichia wadei
MYMKITKIDGVSHYKKQDKGILKKKWKDLDERKQREKIEARYNKQIESKIYKEFFRLKNKKRIEKEEDQNIKSLYFFIKELYLNEKNEEWELKNINLEILDDKERVIKGYKFKEDVYFFKEGYKEYYLRILFNNLIEKVQNENREKVRKNKEFLDLKEIFKKYKNRKIDLLLKSINNNKINLEYKKENVNEEIYGINPTNDREMTFYELLKEIIEKKDEQKSILEEKLDNFDITNFLENIEKIFNEETEINIIKGKVLNELREYIKEKEENNSDNKLKQIYNLELKKYIENNFSYKKQKSKSKNGKNDYLYLNFLKKIMFIEEVDEKKEINKEKFKNKINSNFKNLFVQHILDYGKLLYYKENDEYIKNTGQLETKDLEYIKTKETLIRKMAVLVSFAANSYYNLFGRVSGDILGTEVVKSSKTNVIKVGSHIFKEKMLNYFFDFEIFDANKIVEILESISYSIYNVRNGVGHFNKLILGKYKKKDINTNKRIEEDLNNNEEIKGYFIKKRGEIERKVKEKFLSNNLQYYYSKEKIENYFEVYEFEILKRKIPFAPNFKRIIKKGEDLFNNKNNKKYEYFKNFDKNSAEEKKEFLKTRNFLLKELYYNNFYKEFLSKKEEFEKIVLEVKEEKKSRGNINNKKSGVSFQSIDDYDTKINISDYIASIHKKEMERVEKYNEEKQKDTAKYIRDFVEEIFLTGFINYLEKDKRLHFLKEEFSILCNNNNNVVDFNININEEKIKEFLKENDSKTLNLYLFFNMIDSKRISEFRNELVKYKQFTKKRLDEEKEFLGIKIELYETLIEFVILTREKLDTKKSEEIDAWLVDKLYVKDSNEYKEYEEILKLFVDEKILSSKEAPYYATDNKTPILLSNFEKTRKYGTQSFLSEIQSNYKYSKVEKENIEDYNKKEEIEQKKKSNIEKLQDLKVELHKKWEQNKITEKEIEKYNNTTRKINEYNYLKNKEELQNVYLLHEMLSDLLARNVAFFNKWERDFKFIVIAIKQFLRENDKEKVNEFLNPPDNSKGKKVYFSVSKYKNTVENIDGIHKNFMNLIFLNNKFMNRKIDKMNCAIWVYFRNYIAHFLHLHTKNEKISLISQMNLLIKLFSYDKKVQNHILKSTKTLLEKYNIQINFEISNDKNEVFKYKIKNRLYSKKGKMLGKNNKFEILENEFLENVKAMLEYSE

SEQ ID NO: 585 - protein, 1180 aa, Leptotrichia wadei
MKITKIDGVSHYKKQDKGILKKKWKDLDERKQREKIEARYNKQIESKIYKEFFRLKNKKRIEKEEDQNIKSLYFFIKELYLNEKNEEWELKNINLEILDDKERVIKGYKFKEDVYFFKEGYKEYYLRILFNNLIEKVQNENREKVRKNKEFLDLKEIFKKYKNRKIDLLLKSINNNKINLEYKKENVNEEIYGINPTNDREMTFYELLKEIIEKKDEQKSILEEKLDNFDITNFLENIEKIFNEETEINIIKGKVLNELREYIKEKEENNSDNKLKQIYNLELKKYIENNFSYKKQKSKSKNGKNDYLYLNFLKKIMFIEEVDEKKEINKEKFKNKINSNFKNLFVQHILDYGKLLYYKENDEYIKNTGQLETKDLEYIKTKETLIRKMAVLVSFAANSYYNLFGRVSGDILGTEVVKSSKTNVIKVGSHIFKEKMLNYFFDFEIFDANKIVEILESISYSIYNVRNGVGHFNKLILGKYKKKDINTNKRIEEDLNNNEEIKGYFIKKRGEIERKVKEKFLSNNLQYYYSKEKIENYFEVYEFEILKRKIPFAPNFKRIIKKGEDLFNNKNNKKYEYFKNFDKNSAEEKKEFLKTRNFLLKELYYNNFYKEFLSKKEEFEKIVLEVKEEKKSRGNINNKKSGVSFQSIDDYDTKINISDYIASIHKKEMERVEKYNEEKQKDTAKYIRDFVEEIFLTGFINYLEKDKRLHFLKEEFSILCNNNNNVVDFNININEEKIKEFLKENDSKTLNLYLFFNMIDSKRISEFRNELVKYKQFTKKRLDEEKEFLGIKIELYETLIEFVILTREKLDTKKSEEIDAWLVDKLYVKDSNEYKEYEEILKLFVDEKILSSKEAPYYATDNKTPILLSNFEKTRKYGTQSFLSEIQSNYKYSKVEKENIEDYNKKEEIEQKKKSNIEKLQDLKVELHKKWEQNKITEKEIEKYNNTTRKINEYNYLKNKEELQNVYLLHEMLSDLLARNVAFFNKWERDFKFIVIAIKQFLRENDKEKVNEFLNPPDNSKGKKVYFSVSKYKNTVENIDGIHKNFMNLIFLNNKFMNRKIDKMNCAIWVYFRNYIAHFLHLHTKNEKISLISQMNLLIKLFSYDKKVQNHILKSTKTLLEKYNIQINFEISNDKNEVFKYKIKNRLYSKKGKMLGKNNKFEILENEFLENVKAMLEYSE

SEQ ID NO: 586 - protein, 1197 aa, Leptotrichia wadei
MKVTKIDGLSHKKFEDEGKLVKFRNNKNINEIKERLKKLKELKLDNYIKNPENVKNKDKDAEKETKIRRTNLKKYFSEIILRKEDEKYILKKTKKFKDINQEIDYYDVKSKKNQQEIFDVLKEILELKIKETEKEEIITFDSEKLKKVFGEDFVKKEAKIKAIEKSLKINKANYKKDSIKIGDDKYSNVKGENKRSRIYEYYKKSENLKKFEENIREAFEKLYTEENIKELYSKIEEILKKTHLKSIVREFYQNEIIGESEFSKKNGDGISILYNQIKDSIKKEENFIEFIENTGNLELKELTKSQIFYKYFLENEELNDENIKFAFCYFVEIEVNNLLKENVYKIKRFNESNKKRIENIFEYGKLKKLIVYKLENKLNNYVRNCGKYNYHMENGDIATSDINMRNRQTEAFLRSIIGVSSFGYFSLRNILGVNDDDFYETEEDLTKKERRNLEKAKEDITIKNTFDEVVVKSFQKKGIYNIKENLKMFYGDSFDNADKDELKQFFVNMLNAITSIRHRVVHYNMNTNSENIFNFSGIEVSKLLKSIFEKETDKRELKLKIFRQLNSAGVFDYWENRKIDKYLENIEFKFVNKNIPFVPSFTKLYNRIDNLKGNNALNLGYINIPKRKEARDSQIYLLKNIYYGEFVEKFVNNNDNFEKIFREIIEINKKDGTNTKTKFYKLEKFETLKANAPIEYLEKLQSLHQINYNREKVEEDKDIYVDFVQKIFLKGFINYLQGSDLLKSLNLLNLKKDEAIANKKSFYDEKLKLWQNNGSNLSKMPEEIYDYIKKIKINKINYSDRMSIFYLLLKLIDHKELTNLRGNLEKYVSMNKNKIYSEELNIVNLVSLDNNKVRANFNLKPEDIGKFLKTETSIRNINQLNNFSEIFADGENVIKHRSFYNIKKYGILDLLEKIVDKADLKITKEEIKKYENLQNELKRNDFYKIQERIHRNYNQKPFLIKNNEKDFNDYKKAIENIQNYTQLKNKIEFNDLNLLQSLLFRILHRLAGYTSLWERDLQFKLKGEYPENKYIDEIFNFDNSKNKIYNEKNERGGSVVSKYGYFLVEKDGEIQRKNARDKKKNKIIKKEGLEIRNYIAHFNYIPDATKSILEILEELRNLLKYDRKLKNAVMKSIKDIFKEYGLIIEFKISHVNNSEKIEVLNVDSEKIKHLKNNGLVTTRNSEDLCELIKMMLEYKKS

SEQ ID NO: 587 - protein, 1152 aa, Leptotrichia wadei; identical to SEQ ID NO: 58

SEQ ID NO: 588 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 589 - protein, 913 aa, Leptotrichia sp.
MKELIEKVPNVSELKKSQVFYKYYLNKEKLNDENIKYVFCHFVEIEMSKLLKNYVYKKPSNISNDKVKRIFEYQSLKKLIENKLLNKLDTYIRNCGKYSFYLQDGEIATSDFIVGNRQNEAFLRNIIGVSSAAYFSLRNILETENENDITGKMRGKTVKNKKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLCIYWKIPKANDNNKTKEITDAQIYLLKNIYYSEFLNYFMSNNGNFFEIIKEIIELNKNDKRNLKTGFYKLQKFENLQEKTPKEYLANIQSFYMIDAGNKDEEEKDAYIDFIQKIFLKGFMTYLANNGRLSLMYIGNDEQINTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSNKKNEIEKNHTNQENLHRKYARPRKDEKFNDEDYKKYEKAIRNIQQYTHLKNKVEFNELNLLQSLLLRILHRLVGYTSIWERDLRFRLKGEFPENQYIEEIFNFNNSKNVKYKNGQIVEKYISFYKELYKDDTEKISIYSDKKVKELKKEKKDLYIRNYIAHFNYIPNAEISLLEVLENLRKLLSYDRKLKNAIMKSIVDILKEYGFVVTFKIEKDKKIRIESLKSEEVVHLKKLKLKDNDKKKEPIKTYRNSKELCELVKVMFEYKMKEKKSEN

SEQ ID NO: 590 - protein, 1385 aa, Leptotrichia sp.
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 591 - protein, 1389 aa, Leptotrichia shahii; identical to SEQ ID NO: 45

SEQ ID NO: 592 - protein, 10 aa, Lactococcus lactis
FLVNHNYYSF

SEQ ID NO: 593 - protein, 16 aa, Lactococcus lactis
LQKFTGDIENLVKASL

SEQ ID NO: 594 - protein, 9 aa, Lactococcus lactis
VIVPELTFG

SEQ ID NO: 595 - protein, 15 aa, Lactococcus lactis
WIRAGWFIRNRSAHY

SEQ ID NO: 596 - protein, 13 aa, Lactococcus lactis
NKDLFAFMLSIKQ

SEQ ID NO: 597 - protein, 10 aa, Lactococcus lactis
FLHKNSYFRF

SEQ ID NO: 598 - protein, 16 aa, Lactococcus lactis
LFIFSTRLEIFWKKKI

SEQ ID NO: 599 - protein, 9 aa, Lactococcus lactis
ALVEELTFG

SEQ ID NO: 600 - protein, 15 aa, Lactococcus lactis
WMNVVRLYRNKSAHG

SEQ ID NO: 601 - protein, 13 aa, Lactococcus lactis
KSYLYGALYVFKH

SEQ ID NO: 602 - protein, 10 aa, Corynebacterium diphtheriae
LLAQLNYYRL

SEQ ID NO: 603 - protein, 16 aa, Corynebacterium diphtheriae
VFIELDRVELAIQTRL

SEQ ID NO: 604 - protein, 9 aa, Corynebacterium diphtheriae
AAVEVMDWG

SEQ ID NO: 605 - protein, 15 aa, Corynebacterium diphtheriae
WLKSLNILRNYAAHH

SEQ ID NO: 606 - protein, 13 aa, Corynebacterium diphtheriae
GQLSMIQYLHHQL

SEQ ID NO: 607 - protein, 12 aa, Shewanella baltica
MLIENDLDGIEN

SEQ ID NO: 608 - protein, 16 aa, Shewanella baltica
NYQLFYFLEKTIRNQI

SEQ ID NO: 609 - protein, 15 aa, Shewanella baltica
VMFNLNTLRNPIAHC

SEQ ID NO: 610 - protein, 13 aa, Shewanella baltica
DEKLRLEISLRDW

SEQ ID NO: 611 - protein, 12 aa, Lactococcus lactis
LREINIKASKSR

SEQ ID NO: 612 - protein, 16 aa, Lactococcus lactis
LLPLLHKYEWSLRKLI

SEQ ID NO: 613 - protein, 9 aa, Lactococcus lactis
YDFEEYLFG

SEQ ID NO: 614 - protein, 15 aa, Lactococcus lactis
DMRLIRDGRNIVGHN

SEQ ID NO: 615 - protein, 13 aa, Lactococcus lactis
LSKGLKKYIKKLD

SEQ ID NO: 616 - protein, 12 aa, Geobacter bemidjiensis
RLPLTSHIQKQD

SEQ ID NO: 617 - protein, 16 aa, Geobacter bemidjiensis
IYPKLNRIENRLRHYL

SEQ ID NO: 618 - protein, 9 aa, Geobacter bemidjiensis
FELGKIVYA

SEQ ID NO: 619 - protein, 15 aa, Geobacter bemidjiensis
KWIRLEEIRHKVAHN

SEQ ID NO: 620 - protein, 13 aa, Geobacter bemidjiensis
ANEYIDSLQSIID

SEQ ID NO: 621 - protein, 12 aa, Salmonella enterica
FVTSLEHLRQQQ

SEQ ID NO: 622 - protein, 16 aa, Salmonella enterica
AQRQLRAIELTLKALI

SEQ ID NO: 623 - protein, 9 aa, Salmonella enterica
NHYLKQHFG

SEQ ID NO: 624 - protein, 15 aa, Salmonella enterica
FLDDCRLARNEVIAR

SEQ ID NO: 625 - protein, 13 aa, Salmonella enterica
LMLLNVQYQQIVR

SEQ ID NO: 626 - protein, 12 aa, Shigella flexneri
FLWQLEYLREKQ

SEQ ID NO: 627 - protein, 16 aa, Shigella flexneri
SLQQVRALELTIRSLI

SEQ ID NO: 628 - protein, 9 aa, Shigella flexneri
LEHLNKLFG

SEQ ID NO: 629 - protein, 15 aa, Shigella flexneri
FLDDIRVIRNRLAHH

SEQ ID NO: 630 - protein, 13 aa, Shigella flexneri
TTLVNYYYREITE

SEQ ID NO: 631 - protein, 16 aa, Streptomyces avermitilis
AYIWLNLVEQRLRAVV

SEQ ID NO: 632 - protein, 9 aa, Streptomyces avermitilis
NVLSFLTLP

SEQ ID NO: 633 - protein, 11 aa, Streptomyces avermitilis
LEVTRNVVSRN

SEQ ID NO: 634 - protein, 13 aa, Streptomyces avermitilis
RYGDVVGVHPDRV

SEQ ID NO: 635 - protein, 10 aa, Helicobacter pylori
SISVLHYDYL

SEQ ID NO: 636 - protein, 16 aa, Helicobacter pylori
LFLWIHFFETALRSKM

SEQ ID NO: 637 - protein, 9 aa, Helicobacter pylori
QILNLFTLG

SEQ ID NO: 638 - protein, 15 aa, Helicobacter pylori
TFSLIRKARNDLFHN

SEQ ID NO: 639 - protein, 13 aa, Helicobacter pylori
TLKLERAIFFKTI

SEQ ID NO: 640 - protein, 11 aa, Methylomirabilis oxyfera
GPPEYYYRLCR

SEQ ID NO: 641 - protein, 16 aa, Methylomirabilis oxyfera
ADSKLKDTVSEMRKFI

SEQ ID NO: 642 - protein, 15 aa, Methylomirabilis oxyfera
WMNRINELRRIPAHP

SEQ ID NO: 643 - protein, 13 aa, Methylomirabilis oxyfera
DFEYIDFIYDELM

SEQ ID NO: 644 - protein, 12 aa, Novosphingobium aromaticivorans
TAVKQQSFGMEA

SEQ ID NO: 645 - protein, 16 aa, Novosphingobium aromaticivorans
AAAKVTQIHKKLFNYV

SEQ ID NO: 646 - protein, 15 aa, Novosphingobium aromaticivorans
WIKVLNDIRQYTAHP

SEQ ID NO: 647 - protein, 13 aa, Novosphingobium aromaticivorans
QVSFVNEVYEKVE

SEQ ID NO: 648 - protein, 11 aa, Elizabethkingia anophelis
GEIKYWRTFQK

SEQ ID NO: 649 - protein, 16 aa, Elizabethkingia anophelis
AIAYIRDIETEFKSDF

SEQ ID NO: 650 - protein, 15 aa, Elizabethkingia anophelis
WMVKLERIRNQNFHS

SEQ ID NO: 651 - protein, 13 aa, Elizabethkingia anophelis
ELSFLEELHDWIY

SEQ ID NO: 652 - protein, 12 aa, Escherichia coli
FSALPRIIEYAY

SEQ ID NO: 653 - protein, 16 aa, Escherichia coli
PFLLLSEIENHIRKLI

SEQ ID NO: 654 - protein, 9 aa, Escherichia coli
ESVADLTFG

SEQ ID NO: 655 - protein, 15 aa, Escherichia coli
ELDKVRIIRNDVMHF

SEQ ID NO: 656 - protein, 13 aa, Escherichia coli
NHELLHNFVRFIH

SEQ ID NO: 657 - protein, 12 aa, Haloarcula marismortui
FELFDTLAEDDY

SEQ ID NO: 658 - protein, 16 aa, Haloarcula marismortui
PFLQIGEIEESLRHLF

SEQ ID NO: 659 - protein, 9 aa, Haloarcula marismortui
DRPEDFSFD

SEQ ID NO: 660 - protein, 15 aa, Haloarcula marismortui
LLEDIRETRNALLHF

SEQ ID NO: 661 - protein, 13 aa, Haloarcula marismortui
DRDQLDMAHGYFT

SEQ ID NO: 662 - protein, 12 aa, Nostoc sp.
MKLLPILQQNPR

SEQ ID NO: 663 - protein, 15 aa, Nostoc sp.
FGLVTLLEMNLLRLV

SEQ ID NO: 664 - protein, 9 aa, Nostoc sp.
DLLDYLQFC

SEQ ID NO: 665 - protein, 15 aa, Nostoc sp.
FLKSAEQLRNRLAHA

SEQ ID NO: 666 - protein, 13 aa, Nostoc sp.
SWNDLISLAEAME

SEQ ID NO: 667 - protein, 10 aa, Xanthobacter autotrophicus
VFEGMELLPA

SEQ ID NO: 668 - protein, 14 aa, Xanthobacter autotrophicus
ALIPFVEKRLETSL

SEQ ID NO: 669 - protein, 8 aa, Xanthobacter autotrophicus
EAFKAVLG

SEQ ID NO: 670 - protein, 15 aa, Xanthobacter autotrophicus
LVNELGDVRNKLSHN

SEQ ID NO: 671 - protein, 13 aa, Xanthobacter autotrophicus
YDDAERALDTMRR

SEQ ID NO: 672 - protein, 10 aa, Methanospirillum hungatei
VGRAMDQLKT

SEQ ID NO: 673 - protein, 14 aa, Methanospirillum hungatei
GLMRFVEREMKSAY

SEQ ID NO: 674 - protein, 8 aa, Methanospirillum hungatei
KVFSQILG

SEQ ID NO: 675 - protein, 15 aa, Methanospirillum hungatei
LVSELRETRNQWAHQ

SEQ ID NO: 676 - protein, 13 aa, Methanospirillum hungatei
TNDTLRALDSTAR

SEQ ID NO: 677 - protein, 10 aa, Roseiflexus sp.
IGKALDLLRQ

SEQ ID NO: 678 - protein, 14 aa, Roseiflexus sp.
GLQPFIERELQNHY

SEQ ID NO: 679 - protein, 8 aa, Roseiflexus sp.
DVFRKTLG

SEQ ID NO: 680 - protein, 15 aa, Roseiflexus sp.
LVSELREWRNKWAHQ

SEQ ID NO: 681 - protein, 13 aa, Roseiflexus sp.
TDDTYRVLDSAAR

SEQ ID NO: 682 - protein, 10 aa, Plasmodium yoelii
ILNIFHILSA

SEQ ID NO: 683 - protein, 14 aa, Plasmodium yoelii
HLSPIIEQIMEMEY

SEQ ID NO: 684 - protein, 7 aa, Plasmodium yoelii
DIFENRI

SEQ ID NO: 685 - protein, 15 aa, Plasmodium yoelii
ILENLQKASIFWANQ

SEQ ID NO: 686 - protein, 13 aa, Plasmodium yoelii
EFFLSNLVSSYFF

SEQ ID NO: 687 - protein, 10 aa, Theileria parva
VVMIFQCVCD

SEQ ID NO: 688 - protein, 14 aa, Theileria parva
AFQPFISKCMLKKF

SEQ ID NO: 689 - protein, 7 aa, Theileria parva
DIFEQVL

SEQ ID NO: 690 - protein, 15 aa, Theileria parva
HLNTIQTASIYWANQ

SEQ ID NO: 691 - protein, 8 aa, Theileria parva
NYGKCRKI

SEQ ID NO: 692 - protein, 10 aa, Daphnia pulex
SSKESAAIAI

SEQ ID NO: 693 - protein, 14 aa, Daphnia pulex
GHIVFDTFLEDVAP

SEQ ID NO: 694 - protein, 8 aa, Daphnia pulex
DCFIIPPG

SEQ ID NO: 695 - protein, 15 aa, Daphnia pulex
ILERAMDGRHAVSHH

SEQ ID NO: 696 - protein, 13 aa, Daphnia pulex
WEQHLKDYVYILT

SEQ ID NO: 697 - protein, 10 aa, Homo sapiens
AGHCLLLLRS

SEQ ID NO: 698 - protein, 16 aa, Homo sapiens
CLQGFVGREVLSFHRG

SEQ ID NO: 699 - protein, 15 aa, Homo sapiens
KVTEVIKCRNEIMHS

SEQ ID NO: 700 - protein, 13 aa, Homo sapiens
SSTWLRDFQMKIQ

SEQ ID NO: 701 - protein, 10 aa, Branchiostoma floridae
VGIALLTTRD

SEQ ID NO: 702 - protein, 16 aa, Branchiostoma floridae
GLTNVTEQAAKELQAE

SEQ ID NO: 703 - protein, 15 aa, Branchiostoma floridae
PLKNVIEVRNKTMHS

SEQ ID NO: 704 - protein, 13 aa, Branchiostoma floridae
DRQTFNEYMDKME

SEQ ID NO: 705 - protein, 10 aa, Homo sapiens
VSDLEKSLGT

SEQ ID NO: 706 - protein, 14 aa, Homo sapiens
GLSSILETEMKIAF

SEQ ID NO: 707 - protein, 8 aa, Homo sapiens
KHWLAVFG

SEQ ID NO: 708 - protein, 16 aa, Homo sapiens
TIESLYKNLRKANKAV

SEQ ID NO: 709 - protein, 13 aa, Homo sapiens
SRSLLHAFSTRSN

SEQ ID NO: 710 - protein, 10 aa, Ostreococcus lucimarinus
MERLMMVLDH

SEQ ID NO: 711 - protein, 14 aa, Ostreococcus lucimarinus
VLAIVLEGGLRAEF

SEQ ID NO: 712 - protein, 8 aa, Ostreococcus lucimarinus
ANWGSLFS

SEQ ID NO: 713 - protein, 14 aa, Ostreococcus lucimarinus
EIEVLLDAAIRQRK

SEQ ID NO: 714 - protein, 13 aa, Ostreococcus lucimarinus
ARDVSSAAVALLN

SEQ ID NO: 715 - protein, 10 aa, Branchiostoma floridae
LCGMKTLLKA

SEQ ID NO: 716 - protein, 14 aa, Branchiostoma floridae
VLAVVLETEMKAVF

SEQ ID NO: 717 - protein, 8 aa, Branchiostoma floridae
KHWIAVFG

SEQ ID NO: 718 - protein, 17 aa, Branchiostoma floridae
HLDSLVKHFTRGRSYGV

SEQ ID NO: 719 - protein, 13 aa, Branchiostoma floridae
ALQLVRQLHNHST

SEQ ID NO: 720 - protein, 10 aa, Microcystis aeruginosa
LNWLDQLHDD

SEQ ID NO: 721 - protein, 16 aa, Microcystis aeruginosa
LIELCGWIEETMDDIV

SEQ ID NO: 722 - protein, 9 aa, Microcystis aeruginosa
FRKMLMMVI

SEQ ID NO: 723 - protein, 15 aa, Microcystis aeruginosa
YLGNLKDSRNRAAHT

SEQ ID NO: 724 - protein, 13 aa, Microcystis aeruginosa
FDKIYGLLKELDA

SEQ ID NO: 725 - protein, 12 aa, Lactococcus lactis
LSELHEFIKKLN

SEQ ID NO: 726 - protein, 16 aa, Lactococcus lactis
VIRSCGIIEQLTKTLI

SEQ ID NO: 727 - protein, 9 aa, Lactococcus lactis
INGLIDTFD

SEQ ID NO: 728 - protein, 15 aa, Lactococcus lactis
HIDSLRQLRNSIAHG

SEQ ID NO: 729 - protein, 13 aa, Lactococcus lactis
MGYFDSCIILMFR

SEQ ID NO: 730 - protein, 12 aa, Frankia sp.
LSELAALVQDQA

SEQ ID NO: 731 - protein, 16 aa, Frankia sp.
VIRSCGYLEQTVAGTF

SEQ ID NO: 732 - protein, 9 aa, Frankia sp.
LETLAGRFD

SEQ ID NO: 733 - protein, 15 aa, Frankia sp.
ELATLVDRRNRIAHG

SEQ ID NO: 734 - protein, 13 aa, Frankia sp.
LELHRVACEAADW

SEQ ID NO: 735 - protein, 10 aa, Neisseria meningitidis
CCSIFSDFRM

SEQ ID NO: 736 - protein, 16 aa, Neisseria meningitidis
LFHVVSIFEIVLRNKI

SEQ ID NO: 737 - protein, 9 aa, Neisseria meningitidis
QLVAGLGFG

SEQ ID NO: 738 - protein, 15 aa, Neisseria meningitidis
ELSNINKFRNRLAHH

SEQ ID NO: 739 - protein, 13 aa, Neisseria meningitidis
DVDTASVFSHFSD

SEQ ID NO: 740 - protein, 10 aa, Pseudomonas syringae
LEKHFSSARL

SEQ ID NO: 741 - protein, 16 aa, Pseudomonas syringae
MMPMLSVLEIALKNGI

SEQ ID NO: 742 - protein, 9 aa, Pseudomonas syringae
KIVAELAFG

SEQ ID NO: 743 - protein, 15 aa, Pseudomonas syringae
ALNLIRNLRNRVFHH

SEQ ID NO: 744 - protein, 13 aa, Pseudomonas syringae
DPQLVPWLAQYDR

SEQ ID NO: 745 - protein, 10 aa, Geobacter uraniireducens
LRRAISHERL

SEQ ID NO: 746 - protein, 16 aa, Geobacter uraniireducens
LYTPLQCLEVCLRNSI

SEQ ID NO: 747 - protein, 9 aa, Geobacter uraniireducens
RIIPELTFG

SEQ ID NO: 748 - protein, 15 aa, Geobacter uraniireducens
RFNHIRTLRNRIFHH

SEQ ID NO: 749 - protein, 13 aa, Geobacter uraniireducens
NPAMMTFVEPFDS

SEQ ID NO: 750 - protein, 16 aa, Sulfuricurvum kujiense
EEKSEFIREFFKRTLH

SEQ ID NO: 751 - protein, 9 aa, Sulfuricurvum kujiense
TQTINSFLG

SEQ ID NO: 752 - protein, 14 aa, Sulfuricurvum kujiense
FRNYLKRLRNAVSH

SEQ ID NO: 753 - protein, 13 aa, Sulfuricurvum kujiense
VNLLITLLSRNIL

SEQ ID NO: 754 - protein, 13 aa, Dethiobacter alkaliphilus
QVVEKDFVARTMH

SEQ ID NO: 755 - protein, 9 aa, Dethiobacter alkaliphilus
TLLINCLLG

SEQ ID NO: 756 - protein, 14 aa, Dethiobacter alkaliphilus
ASRFLQCMRNSVAH

SEQ ID NO: 757 - protein, 10 aa, Dethiobacter alkaliphilus
LATKLAQYVQ

SEQ ID NO: 758 - protein, 13 aa, Klebsiella pneumoniae
SDFETDFVQRTLA

SEQ ID NO: 759 - protein, 9 aa, Klebsiella pneumoniae
TLTLNCLLG

SEQ ID NO: 760 - protein, 14 aa, Klebsiella pneumoniae
LRQLIHKMRNSVAH

SEQ ID NO: 761 - protein, 13 aa, Klebsiella pneumoniae
LLPFLKYYATLLL

SEQ ID NO: 762 - protein, 10 aa, Lactobacillus casei
KIDREMFWRR

SEQ ID NO: 763 - protein, 16 aa, Lactobacillus casei
YLLLYSSWEGFIRSIA

SEQ ID NO: 764 - protein, 9 aa, Lactobacillus casei
LARIVSVLD

SEQ ID NO: 765 - protein, 14 aa, Lactobacillus casei
DRDLLKVRNEIAHG

SEQ ID NO: 766 - protein, 13 aa, Lactobacillus casei
TVSHVLEMMDLFS

SEQ ID NO: 767 - protein, 10 aa, Caulobacter sp.
DLDAARLRRA

SEQ ID NO: 768 - protein, 16 aa, Caulobacter sp.
IVLAYSHWEGFYNECI

SEQ ID NO: 769 - protein, 9 aa, Caulobacter sp.
LKENFRILG

SEQ ID NO: 770 - protein, 14 aa, Caulobacter sp.
NKELVGWRHSIAHG

SEQ ID NO: 771 - protein, 13 aa, Caulobacter sp.
HIILTNSLLLTLS

SEQ ID NO: 772 - protein, 10 aa, Microcystis aeruginosa
NLDEDMAWRI

SEQ ID NO: 773 - protein, 16 aa, Microcystis aeruginosa
ITTLYAHWEGFIKYAA

SEQ ID NO: 774 - protein, 9 aa, Microcystis aeruginosa
FTDICTILG

SEQ ID NO: 775 - protein, 14 aa, Microcystis aeruginosa
DEQLLTQRNKIAHG

SEQ ID NO: 776 - protein, 13 aa, Microcystis aeruginosa
TYNLVIKLIRDFK

SEQ ID NO: 777 - protein, 11 aa, Arabidopsis thaliana
PWLSWEEWDSV

SEQ ID NO: 778 - protein, 15 aa, Arabidopsis thaliana
GSLPAPVDVTCSLIE

SEQ ID NO: 779 - protein, 9 aa, Arabidopsis thaliana
IADAARAIG

SEQ ID NO: 780 - protein, 15 aa, Arabidopsis thaliana
IPRKLIDLRHEGSHR

SEQ ID NO: 781 - protein, 13 aa, Arabidopsis thaliana
AADEALEWLKSYY

SEQ ID NO: 782 - protein, 11 aa, Homo sapiens
AWLSRAEWDQV

SEQ ID NO: 783 - protein, 16 aa, Homo sapiens
GNELPLAVASTADLIR

SEQ ID NO: 784 - protein, 9 aa, Homo sapiens
LKCLAQEVN

SEQ ID NO: 785 - protein, 15 aa, Homo sapiens
IPDWIVDLRHELTHK

SEQ ID NO: 786 - protein, 13 aa, Homo sapiens
GCYFVLDWLQKTY

SEQ ID NO: 787 - protein, 11 aa, Saccharomyces cerevisiae
PWRDFAELEEL

SEQ ID NO: 788 - protein, 16 aa, Saccharomyces cerevisiae
SQYLPHVVDSTAQITC

SEQ ID NO: 789 - protein, 9 aa, Saccharomyces cerevisiae
LHTLAAKIG

SEQ ID NO: 790 - protein, 15 aa, Saccharomyces cerevisiae
LPSWFVDLRHWGTHE

SEQ ID NO: 791 - protein, 13 aa, Saccharomyces cerevisiae
AANEALSWLYDHY

SEQ ID NO: 792 - protein, 11 aa, Streptococcus pneumoniae
SKPCIEAENMI

SEQ ID NO: 793 - protein, 16 aa, Streptococcus pneumoniae
AFMARRALEQAVHWIY

SEQ ID NO: 794 - protein, 8 aa, Streptococcus pneumoniae
SSLVWDDD

SEQ ID NO: 795 - protein, 15 aa, Streptococcus pneumoniae
QIVLLIRWGNHAAHG

SEQ ID NO: 796 - protein, 13 aa, Streptococcus pneumoniae
ALHHLYQFVNFID

SEQ ID NO: 797 - protein, 11 aa, Microcystis aeruginosa
YDHASQAEGLV

SEQ ID NO: 798 - protein, 16 aa, Microcystis aeruginosa
CFYTRFVLEQMVCWLY

SEQ ID NO: 799 - protein, 8 aa, Microcystis aeruginosa
GALIHEQT

SEQ ID NO: 800 - protein, 15 aa, Microcystis aeruginosa
KIRTIHKVGNNAAHD

SEQ ID NO: 801 - protein, 13 aa, Microcystis aeruginosa
LIEELFHLTYWLV

SEQ ID NO: 802 - protein, 11 aa, Escherichia coli
YAIACAAENNY

SEQ ID NO: 803 - protein, 16 aa, Escherichia coli
LIKMRMFGEATAKHLG

SEQ ID NO: 804 - protein, 8 aa, Escherichia coli
HDLLRELG

SEQ ID NO: 805 - protein, 15 aa, Escherichia coli
VFHKLRRIGNQAVHE

SEQ ID NO: 806 - protein, 13 aa, Escherichia coli
CLRLGFRLAVWYY

SEQ ID NO: 807 - protein, 11 aa, Bradyrhizobium japonicum
VQKLIKASQLA

SEQ ID NO: 808 - protein, 16 aa, Bradyrhizobium japonicum
LTEVRRAMKAAADLFW

SEQ ID NO: 809 - protein, 10 aa, Bradyrhizobium japonicum
LNRLQEFARV

SEQ ID NO: 810 - protein, 13 aa, Bradyrhizobium japonicum
RRLNDLASKGVHA

SEQ ID NO: 811 - protein, 13 aa, Bradyrhizobium japonicum
AEARQGLVGLYFF

SEQ ID NO: 812 - protein, 11 aa, Leptospira meyeri
LPKFSAIYSNL

SEQ ID NO: 813 - protein, 16 aa, Leptospira meyeri
VHSCRRLLQSVADKLM

SEQ ID NO: 814 - protein, 10 aa, Leptospira meyeri
INRLIYYIET

SEQ ID NO: 815 - protein, 13 aa, Leptospira meyeri
DSVFQASQKGSHS

SEQ ID NO: 816 - protein, 13 aa, Leptospira meyeri
QEADRYVIHTFLL

SEQ ID NO: 817 - protein, 11 aa, Bacteroides coprosuis
VVDDRDFSLLA

SEQ ID NO: 818 - protein, 16 aa, Bacteroides coprosuis
LDRLHTYVIKFIRQLC

SEQ ID NO: 819 - protein, 9 aa, Bacteroides coprosuis
FGKYVKFIV

SEQ ID NO: 820 - protein, 16 aa, Bacteroides coprosuis
IEAFNDIRNNKSFAHD

SEQ ID NO: 821 - protein, 13 aa, Bacteroides coprosuis
YAESVLIFNNVTN

SEQ ID NO: 822 - protein, 10 aa, Escherichia coli
NVNENIYQAL

SEQ ID NO: 823 - protein, 16 aa, Escherichia coli
YDRVHTALHASLRQMC

SEQ ID NO: 824 - protein, 9 aa, Escherichia coli
LSLITAHLK

SEQ ID NO: 825 - protein, 16 aa, Escherichia coli
LHGINNLRNNYSMAHP

SEQ ID NO: 826 - protein, 13 aa, Escherichia coli
EADARFAINLVRS

SEQ ID NO: 827 - protein, 11 aa, Lactococcus lactis
IMNIGYVEKIL

SEQ ID NO: 828 - protein, 16 aa, Lactococcus lactis
VTKSRTIIETVFIAIL

SEQ ID NO: 829 - protein, 9 aa, Lactococcus lactis
RSLVNKTLG

SEQ ID NO: 830 - protein, 16 aa, Lactococcus lactis
VDSITTMRNINSDSHG

SEQ ID NO: 831 - protein, 13 aa, Lactococcus lactis
EAEAELILNSAVN

SEQ ID NO: 832 - protein, 11 aa, Peptoniphilus indolicus
FLYLKTLKNKE

SEQ ID NO: 833 - protein, 16 aa, Peptoniphilus indolicus
RGITPLVTELFILIID

SEQ ID NO: 834 - protein, 9 aa, Peptoniphilus indolicus
LIEIIKNER

SEQ ID NO: 835 - protein, 15 aa, Peptoniphilus indolicus
IRDVEGKLRNRAAHE

SEQ ID NO: 836 - protein, 13 aa, Peptoniphilus indolicus
GNNHYDSYDLMNK

SEQ ID NO: 837 - protein, 11 aa, Mycobacterium tuberculosis
ISALALLAKRE

SEQ ID NO: 838 - protein, 16 aa, Mycobacterium tuberculosis
RSATPAITIVLRAAVA

SEQ ID NO: 839 - protein, 9 aa, Mycobacterium tuberculosis
WLALLRQFA

SEQ ID NO: 840 - protein, 15 aa, Mycobacterium tuberculosis
LGRFESRVRNTAAHE

SEQ ID NO: 841 - protein, 11 aa, Mycobacterium tuberculosis
ADLTLYDRLND

SEQ ID NO: 842 - protein, 12 aa, Streptococcus thermophilus
YLMIDVLKEREH

SEQ ID NO: 843 - protein, 16 aa, Streptococcus thermophilus
IEEIIKKDHEGLIVFD

SEQ ID NO: 844 - protein, 9 aa, Streptococcus thermophilus
YLNILEFYE

SEQ ID NO: 845 - protein, 14 aa, Streptococcus thermophilus
ILSLNGERNKVAHG

SEQ ID NO: 846 - protein, 13 aa, Streptococcus thermophilus
DSSYFNYYDKQNK

SEQ ID NO: 847 - protein, 10 aa, Synechocystis sp.
LISVVAFRLG

SEQ ID NO: 848 - protein, 16 aa, Synechocystis sp.
ILDHRKQINFALNNGG

SEQ ID NO: 849 - protein, 10 aa, Synechocystis sp.
TEIRNDLAHC

SEQ ID NO: 850 - protein, 12 aa, Synechocystis sp.
NKIFPQLEEIAN

SEQ ID NO: 851 - protein, 5 aa, Methanocaldococcus jannaschii
KNTLF

SEQ ID NO: 852 - protein, 14 aa, Methanocaldococcus jannaschii
KENPNSQYIKNEIS

SEQ ID NO: 853 - protein, 15 aa, Methanocaldococcus jannaschii
ENIDKFKIRNFLAHA

SEQ ID NO: 854 - protein, 13 aa, Methanocaldococcus jannaschii
SEKTSLRYNKNYI

SEQ ID NO: 855 - protein, 11 aa, Pyrococcus furiosus
SKIFESLPRIG

SEQ ID NO: 856 - protein, 15 aa, Pyrococcus furiosus
RQVEWLRNLVYGRLW

SEQ ID NO: 857 - protein, 15 aa, Pyrococcus furiosus
TIESPNVVRNFIAHS

SEQ ID NO: 858 - protein, 13 aa, Pyrococcus furiosus
DKEKAANLAYEAL

SEQ ID NO: 859 - protein, 5 aa, Sulfolobus solfataricus
AETYA

SEQ ID NO: 860 - protein, 13 aa, Sulfolobus solfataricus
DKVTRAIIENEVD

SEQ ID NO: 861 - protein, 13 aa, Sulfolobus solfataricus
GKGFDKRILYAHG

SEQ ID NO: 862 - protein, 10 aa, Sulfolobus solfataricus
DKIDEIERQI

SEQ ID NO: 863 - protein, 12 aa, Desulfococcus oleovorans
FANAERRFDEGK

SEQ ID NO: 864 - protein, 16 aa, Desulfococcus oleovorans
VLRLYRIVEMAGQQRL

SEQ ID NO: 865 - protein, 9 aa, Desulfococcus oleovorans
GYSLLKEMG

SEQ ID NO: 866 - protein, 17 aa, Desulfococcus oleovorans
SFLKIQDSRNHSFLAHG

SEQ ID NO: 867 - protein, 13 aa, Desulfococcus oleovorans
YMSLRDFIVSLNI

SEQ ID NO: 868 - protein, 12 aa, Oscillochloris trichoides
LRNAERRAARAR

SEQ ID NO: 869 - protein, 16 aa, Oscillochloris trichoides
VARLYRATELFAQIRL

SEQ ID NO: 870 - protein, 9 aa, Oscillochloris trichoides
SYALLGKLD

SEQ ID NO: 871 - protein, 17 aa, Oscillochloris trichoides
PLNNALTRRNQSILAHG

SEQ ID NO: 872 - protein, 13 aa, Oscillochloris trichoides
YHDLASHLYTLIN

SEQ ID NO: 873 - protein, 12 aa, Homo sapiens
FPEIFDALESLQ

SEQ ID NO: 874 - protein, 14 aa, Homo sapiens
KLTSCLERALGDVF

SEQ ID NO: 875 - protein, 9 aa, Homo sapiens
SEELAQVFS

SEQ ID NO: 876 - protein, 15 aa, Homo sapiens
GSPCGLNLRNVLWHG

SEQ ID NO: 877 - protein, 13 aa, Homo sapiens
YCSMMILLTAGLG

SEQ ID NO: 878 - protein, 12 aa, Entamoeba histolytica
WFESFQEIIQTP

SEQ ID NO: 879 - protein, 14 aa, Entamoeba histolytica
LLSVQFNVHLKDNI

SEQ ID NO: 880 - protein, 9 aa, Entamoeba histolytica
KMYEEHTVP

SEQ ID NO: 881 - protein, 15 aa, Entamoeba histolytica
GPPTGLNLRNLLWHG

SEQ ID NO: 882 - protein, 13 aa, Entamoeba histolytica
HICLLIILYQTIQ

SEQ ID NO: 883 - protein, 12 aa, Staphylococcus aureus
IEHGISRFLEKD

SEQ ID NO: 884 - protein, 14 aa, Staphylococcus aureus
ILVPQFESTVRRMF

SEQ ID NO: 885 - protein, 9 aa, Staphylococcus aureus
RDDVKSTLG

SEQ ID NO: 886 - protein, 15 aa, Staphylococcus aureus
VEQSGLNLRNEIAHG

SEQ ID NO: 887 - protein, 12 aa, Staphylococcus aureus
KCILVIYLFLIL

SEQ ID NO: 888 - protein, 12 aa, Cyanothece sp.
LLKGIQAYLEED

SEQ ID NO: 889 - protein, 14 aa, Cyanothece sp.
LLIPQIEAAIRNLV

SEQ ID NO: 890 - protein, 9 aa, Cyanothece sp.
SEQVKQSLG

SEQ ID NO: 891 - protein, 15 aa, Cyanothece sp.
TDQRGWNVRNNVCHG

SEQ ID NO: 892 - protein, 12 aa, Cyanothece sp.
LTERLIHILLIL

SEQ ID NO: 893 - protein, 9 aa, Sulfolobus solfataricus
ISTSAEVYY

SEQ ID NO: 894 - protein, 16 aa, Sulfolobus solfataricus
CEKYYKAAEEAIKLLV

SEQ ID NO: 895 - protein, 8 aa, Sulfolobus solfataricus
KLLRSNNT

SEQ ID NO: 896 - protein, 15 aa, Sulfolobus solfataricus
LWKSAWTLHVEGFHE

SEQ ID NO: 897 - protein, 13 aa, Sulfolobus solfataricus
LKEDVRKLVIFAV

SEQ ID NO: 898 - protein, 9 aa, Pyrobaculum aerophilum
YAEAARELL

SEQ ID NO: 899 - protein, 16 aa, Pyrobaculum aerophilum
SEKAWGAAALAVKAYA

SEQ ID NO: 900 - protein, 7 aa, Pyrobaculum aerophilum
KIAGELG

SEQ ID NO: 901 - protein, 14 aa, Pyrobaculum aerophilum
AWAQANAMHINFYE

SEQ ID NO: 902 - protein, 13 aa, Pyrobaculum aerophilum
ALKKVSRLVEELT

SEQ ID NO: 903 - protein, 11 aa, Homo sapiens
RRWLRQARANF

SEQ ID NO: 904 - protein, 16 aa, Homo sapiens
NEWVCFKCYLSTKLAL

SEQ ID NO: 905 - protein, 8 aa, Homo sapiens
AQKIEEYS

SEQ ID NO: 906 - protein, 15 aa, Homo sapiens
VHTLEAYGVDSLKTR

SEQ ID NO: 907 - protein, 13 aa, Homo sapiens
  MOD_RES (2)..(2): Any amino acid
VXECTACIIIKLE

SEQ ID NO: 908 - protein, 11 aa, Heamophilus influenzae
KLNLNVLDAAF

SEQ ID NO: 909 - protein, 16 aa, Heamophilus influenzae
  MOD_RES (14)..(15): Any amino acid
IQKFEFVYELSLKXXK

SEQ ID NO: 910 - protein, 8 aa, Heamophilus influenzae
LREALRFG

SEQ ID NO: 911 - protein, 15 aa, Heamophilus influenzae
  MOD_RES (8)..(8): Any amino acid
KWVAYRDXRNITSHT

SEQ ID NO: 912 - protein, 13 aa, Heamophilus influenzae
DFLIESSFLLEQL

SEQ ID NO: 913 - protein, 6 aa, Thermus thermophilus
  MOD_RES (1)..(1): Any amino acid
XAEKAL

SEQ ID NO: 914 - protein, 16 aa, Thermus thermophilus
IQRFEYTFEAFWKALQ

SEQ ID NO: 915 - protein, 8 aa, Thermus thermophilus
IRLAREVG

SEQ ID NO: 916 - protein, 15 aa, Thermus thermophilus
  MOD_RES (5)..(5): Any amino acid
LALGXVDDRSLTVHT

SEQ ID NO: 917 - protein, 13 aa, Thermus thermophilus
  MOD_RES (12)..(12): Any amino acid
IFRRLPDYARLXE

SEQ ID NO: 918 - protein, 11 aa, Rhodococcus equi
VNLLRRADGLL

SEQ ID NO: 919 - protein, 16 aa, Rhodococcus equi
FCAAYVGALRGAAAVL

SEQ ID NO: 920 - protein, 8 aa, Rhodococcus equi
WVLMARAE

SEQ ID NO: 921 - protein, 15 aa, Rhodococcus equi
YFAGYSGLRADLEAG

SEQ ID NO: 922 - protein, 13 aa, Rhodococcus equi
DAEEVDGFYAEVG

SEQ ID NO: 923 - protein, 11 aa, Streptomyces avermitilis
LDLLAQARAGL

SEQ ID NO: 924 - protein, 16 aa, Streptomyces avermitilis
YATAHLAALRTAAAVL

SEQ ID NO: 925 - protein, 8 aa, Streptomyces avermitilis
WEVLPEIA

SEQ ID NO: 926 - protein, 15 aa, Streptomyces avermitilis
LFASGAGRRARAEAG

SEQ ID NO: 927 - protein, 13 aa, Streptomyces avermitilis
SNRDADDLIRDVA

SEQ ID NO: 928 - protein, 11 aa, Staphylococcus aureus
ALIVEELFEYA

SEQ ID NO: 929 - protein, 16 aa, Staphylococcus aureus
PSLTVQVAMAGAMLIG

SEQ ID NO: 930 - protein, 8 aa, Staphylococcus aureus
TEAVKQSD

SEQ ID NO: 931 - protein, 10 aa, Staphylococcus aureus
HLCQFVMSGQ

SEQ ID NO: 932 - protein, 13 aa, Staphylococcus aureus
SEKLLESLENFWN

SEQ ID NO: 933 - protein, 11 aa, Enterococcus faecium
NFLLCNFSNLW

SEQ ID NO: 934 - protein, 16 aa, Enterococcus faecium
LELLSQLQKNTLQLIR

SEQ ID NO: 935 - protein, 10 aa, Enterococcus faecium
KKFAKTTARL

SEQ ID NO: 936 - protein, 13 aa, Enterococcus faecium
KVELFEAYKNSLL

SEQ ID NO: 937 - protein, 9 aa, Escherichia coli
GVYANELRA

SEQ ID NO: 938 - protein, 16 aa, Escherichia coli
GGIREIEFIVQVFQLI

SEQ ID NO: 939 - protein, 8 aa, Escherichia coli
TLSAIAEL

SEQ ID NO: 940 - protein, 15 aa, Escherichia coli
EQLRVAYLFLRRLEN

SEQ ID NO: 941 - protein, 13 aa, Escherichia coli
LTGHMTNVRRVFN

SEQ ID NO: 942 - protein, 11 aa, Sebaldella termitidis
SRCMKIAQSGQ

SEQ ID NO: 943 - protein, 16 aa, Sebaldella termitidis
IAEAEFINESIYMIYL

SEQ ID NO: 944 - protein, 8 aa, Sebaldella termitidis
KDMQFLPI

SEQ ID NO: 945 - protein, 14 aa, Sebaldella termitidis
NLLNNLISIQNSEK

SEQ ID NO: 946 - protein, 13 aa, Sebaldella termitidis
AEKICGLIINELK

SEQ ID NO: 947 - protein, 10 aa, Streptomyces coelicolor
ARLDAYANSH

SEQ ID NO: 948 - protein, 16 aa, Streptomyces coelicolor
LDAADSIGFLLELLFA

SEQ ID NO: 949 - protein, 8 aa, Streptomyces coelicolor
WELDRFPL

SEQ ID NO: 950 - protein, 14 aa, Streptomyces coelicolor
ELLATLGRITGAGG

SEQ ID NO: 951 - protein, 13 aa, Streptomyces coelicolor
QRELFGRVEAAAR

SEQ ID NO: 952 - protein, 11 aa, Flavobacterium psychrophilum
YSIYKNARQLR

SEQ ID NO: 953 - protein, 16 aa, Flavobacterium psychrophilum
TSLLILSSEEVIKSIL

SEQ ID NO: 954 - protein, 8 aa, Flavobacterium psychrophilum
QLIELSIG

SEQ ID NO: 955 - protein, 15 aa, Flavobacterium psychrophilum
KLTEFDDKKNQGFYV

SEQ ID NO: 956 - protein, 13 aa, Flavobacterium psychrophilum
KTEFTETKVVVDR

SEQ ID NO: 957 - protein, 10 aa, Lactococcus lactis
KCIDHISVLI

SEQ ID NO: 958 - protein, 16 aa, Lactococcus lactis
TFISITIIEEVGKTHI

SEQ ID NO: 959 - protein, 8 aa, Lactococcus lactis
SLPTIKMG

SEQ ID NO: 960 - protein, 14 aa, Lactococcus lactis
TGELISIRESSLYA

SEQ ID NO: 961 - protein, 13 aa, Lactococcus lactis
KEQSRALLLYAIE

SEQ ID NO: 962 - protein, 11 aa, Pseudomonas putida
DALLTNAASLI

SEQ ID NO: 963 - protein, 16 aa, Pseudomonas putida
FALAHLAREEIAKTLM

SEQ ID NO: 964 - protein, 8 aa, Pseudomonas putida
TINSIVFC

SEQ ID NO: 965 - protein, 12 aa, Pseudomonas putida
FRNDLKNNSLYV

SEQ ID NO: 966 - protein, 13 aa, Pseudomonas putida
AERALRTITLAWD

SEQ ID NO: 967 - protein, 11 aa, Selenomonas sputigena
QIAYYLYFMYL

SEQ ID NO: 968 - protein, 16 aa, Selenomonas sputigena
MTSFAYYKSYFDRVTA

SEQ ID NO: 969 - protein, 10 aa, Selenomonas sputigena
RLCEFYEEFD

SEQ ID NO: 970 - protein, 17 aa, Selenomonas sputigena
IIDKAQALRYANPLTHS

SEQ ID NO: 971 - protein, 13 aa, Selenomonas sputigena
IRELSTLLDRYIA

SEQ ID NO: 972 - protein, 11 aa, Lactobacillus helveticus
WISYYLYFESI

SEQ ID NO: 973 - protein, 16 aa, Lactobacillus helveticus
LTSYAFFKNYFDRTTA

SEQ ID NO: 974 - protein, 10 aa, Lactobacillus helveticus
QLQKVYRILN

SEQ ID NO: 975 - protein, 17 aa, Lactobacillus helveticus
IISKANDLRNNNPLSHA

SEQ ID NO: 976 - protein, 13 aa, Lactobacillus helveticus
IATMRSLFKLLVE

SEQ ID NO: 977 - protein, 11 aa, Lactococcus lactis
KILNFIYFRAK

SEQ ID NO: 978 - protein, 16 aa, Lactococcus lactis
LESFAYYKNYFDRFVA

SEQ ID NO: 979 - protein, 10 aa, Lactococcus lactis
KLIDGLKQLN

SEQ ID NO: 980 - protein, 17 aa, Lactococcus lactis
IINEAHKIRNSNPVSHS

SEQ ID NO: 981 - protein, 13 aa, Lactococcus lactis
LNDLKIIIEQLST

SEQ ID NO: 982 - protein, 11 aa, Pseudomonas sp.
KWLFIDQMVDL

SEQ ID NO: 983 - protein, 12 aa, Pseudomonas sp.
FKFREIRIEYSQ

SEQ ID NO: 984 - protein, 9 aa, Pseudomonas sp.
YEYAQEIRS

SEQ ID NO: 985 - protein, 14 aa, Pseudomonas sp.
RKIPDFRGKYAAHI

SEQ ID NO: 986 - protein, 13 aa, Pseudomonas sp.
KALEFYNWIHSNE

SEQ ID NO: 987 - protein, 11 aa, Vibrio paracholerae
EEILSGLIGDL

SEQ ID NO: 988 - protein, 12 aa, Vibrio paracholerae
RKYVELNQKYGK

SEQ ID NO: 989 - protein, 10 aa, Vibrio paracholerae
GVYNNEINKN

SEQ ID NO: 990 - protein, 14 aa, Vibrio paracholerae
TAIKKLRNHCVAHV

SEQ ID NO: 991 - protein, 13 aa, Vibrio paracholerae
FADEFLDWICPDN

SEQ ID NO: 992 - protein, 11 aa, Escherichia coli
TMADHMVNEAW

SEQ ID NO: 993 - protein, 16 aa, Escherichia coli
FNLILQSIEFRLKGLI

SEQ ID NO: 994 - protein, 10 aa, Escherichia coli
KVYNTFASKS

SEQ ID NO: 995 - protein, 14 aa, Escherichia coli
WFNSMRILRNRFMH

SEQ ID NO: 996 - protein, 13 aa, Escherichia coli
DIMPELIFTSVVR

SEQ ID NO: 997 - protein, 11 aa, Geobacter sulfurreducens
LNYEALYVKSK

SEQ ID NO: 998 - protein, 16 aa, Geobacter sulfurreducens
QLWASMALELLAKSSL

SEQ ID NO: 999 - protein, 9 aa, Geobacter sulfurreducens
QRLGHISKL

SEQ ID NO: 1000 - protein, 15 aa, Geobacter sulfurreducens
FCEQLSLRRNSEIHS

SEQ ID NO: 1001 - protein, 13 aa, Geobacter sulfurreducens
DAWEVKYWYAIEV

SEQ ID NO: 1002 - protein, 11 aa, Streptomyces coelicolor
DVSYTPVSNGM

SEQ ID NO: 1003 - protein, 16 aa, Streptomyces coelicolor
VLHLQAATEVLLKARL

SEQ ID NO: 1004 - protein, 10 aa, Streptomyces coelicolor
DRLRDIARLD

SEQ ID NO: 1005 - protein, 15 aa, Streptomyces coelicolor
RIKEPGESRNALQHY

SEQ ID NO: 1006 - protein, 13 aa, Streptomyces coelicolor
YAIESRAARVLDF

SEQ ID NO: 1007 - protein, 10 aa, Leptospira interrogans
CTRLYNQILE

SEQ ID NO: 1008 - protein, 16 aa, Leptospira interrogans
YTKLFNILDKVAAIVY

SEQ ID NO: 1009 - protein, 6 aa, Leptospira interrogans
FPSTFG

SEQ ID NO: 1010 - protein, 13 aa, Leptospira interrogans
HHLRVRRNNIVHW

SEQ ID NO: 1011 - protein, 13 aa, Leptospira interrogans
EEDVQRLFLISKA

SEQ ID NO: 1012 - protein, 10 aa, Shigella boydii
MEMVLNRLKS

SEQ ID NO: 1013 - protein, 16 aa, Shigella boydii
FRLCFGILDKIAVAIC

SEQ ID NO: 1014 - protein, 8 aa, Shigella boydii
PQKNIYFQ

SEQ ID NO: 1015 - protein, 15 aa, Shigella boydii
ELAFYKEWRNGLEHK

SEQ ID NO: 1016 - protein, 13 aa, Shigella boydii
IHHFEHLLQITRS

SEQ ID NO: 1017 - protein, 10 aa, Enterococcus faecalis
FYSLFNQIKQ

SEQ ID NO: 1018 - protein, 16 aa, Enterococcus faecalis
YRSVYSIFDKIAYFLN

SEQ ID NO: 1019 - protein, 8 aa, Enterococcus faecalis
PKNLITFH

SEQ ID NO: 1020 - protein, 15 aa, Enterococcus faecalis
NLEKIAEIRNAMEHK

SEQ ID NO: 1021 - protein, 13 aa, Enterococcus faecalis
EKITLELFKLTRE

SEQ ID NO: 1022 - protein, 10 aa, Clostridium thermocellum
FNNRAFDLIV

SEQ ID NO: 1023 - protein, 16 aa, Clostridium thermocellum
YTRFEGLIDTIYHIIN

SEQ ID NO: 1024 - protein, 7 aa, Clostridium thermocellum
KPSSEFR

SEQ ID NO: 1025 - protein, 15 aa, Clostridium thermocellum
VYKKINKFRNNIVHN

SEQ ID NO: 1026 - protein, 13 aa, Clostridium thermocellum
YTTSTEFLNNIKD

SEQ ID NO: 1027 - protein, 10 aa, Bacillus cereus
LNNRIFQLDL

SEQ ID NO: 1028 - protein, 16 aa, Bacillus cereus
FPKAFTALDLLAHLLF

SEQ ID NO: 1029 - protein, 7 aa, Bacillus cereus
KTEKKIK

SEQ ID NO: 1030 - protein, 15 aa, Bacillus cereus
EFQKASKVRNDIIHN

SEQ ID NO: 1031 - protein, 13 aa, Bacillus cereus
YTPSKEILNIARG

SEQ ID NO: 1032 - protein, 10 aa, Pseudomonas syringae
EYLRCKDAFE

SEQ ID NO: 1033 - protein, 16 aa, Pseudomonas syringae
SSFIHHLYELYMALFA

SEQ ID NO: 1034 - protein, 8 aa, Pseudomonas syringae
SIDRGAVS

SEQ ID NO: 1035 - protein, 16 aa, Pseudomonas syringae
FGPAFRSMRNKIAGHV

SEQ ID NO: 1036 - protein, 13 aa, Pseudomonas syringae
VKLTEFFQKYHPY

SEQ ID NO: 1037 - protein, 10 aa, Burkholderia xenovorans
EYLRCDDALH

SEQ ID NO: 1038 - protein, 16 aa, Burkholderia xenovorans
ARFIHHLYEFNIACAQ

SEQ ID NO: 1039 - protein, 8 aa, Burkholderia xenovorans
RVRRQAYN

SEQ ID NO: 1040 - protein, 16 aa, Burkholderia xenovorans
FAKAFRTARNTTNGHA

SEQ ID NO: 1041 - protein, 13 aa, Burkholderia xenovorans
LNLSDFFTRYHRF

SEQ ID NO: 1042 - protein, 10 aa, Microcystis aeruginosa
EHLDCELWER

SEQ ID NO: 1043 - protein, 16 aa, Microcystis aeruginosa
IRNATVILEDRMRKLG

SEQ ID NO: 1044 - protein, 8 aa, Microcystis aeruginosa
GIVNLIFG

SEQ ID NO: 1045 - protein, 15 aa, Microcystis aeruginosa
YSGTMKIFRNRYAHR

SEQ ID NO: 1046 - protein, 13 aa, Microcystis aeruginosa
IIVFIDLLLKMLD

SEQ ID NO: 1047 - protein, 11 aa, Vibrio parahaemolyticus
SRNVHPDVLKY

SEQ ID NO: 1048 - protein, 16 aa, Vibrio parahaemolyticus
VFEATKSVADKIRNKT

SEQ ID NO: 1049 - protein, 8 aa, Vibrio parahaemolyticus
VLVDEAFS

SEQ ID NO: 1050 - protein, 15 aa, Vibrio parahaemolyticus
LKGLFGTFRNTTAHA

SEQ ID NO: 1051 - protein, 13 aa, Vibrio parahaemolyticus
ILSMVSLVHRRLD

SEQ ID NO: 1052 - protein, 11 aa, Lactococcus lactis
ALELHSEVTKY

SEQ ID NO: 1053 - protein, 16 aa, Lactococcus lactis
VFESCKGLFDRIRLIS

SEQ ID NO: 1054 - protein, 8 aa, Lactococcus lactis
TLINQAFN

SEQ ID NO: 1055 - protein, 15 aa, Lactococcus lactis
IKTCLYLYRNHQAHV

SEQ ID NO: 1056 - protein, 13 aa, Lactococcus lactis
GLMSISLAHELLD

SEQ ID NO: 1057 - protein, 11 aa, Nematostella vectensis
STTLTTFLNLH

SEQ ID NO: 1058 - protein, 16 aa, Nematostella vectensis
EDYDITLLTCLLRNIC

SEQ ID NO: 1059 - protein, 8 aa, Nematostella vectensis
DKLPPAYD

SEQ ID NO: 1060 - protein, 15 aa, Nematostella vectensis
VVRLRHYRNDLYAHI

SEQ ID NO: 1061 - protein, 13 aa, Nematostella vectensis
WADISAALLSLGG

SEQ ID NO: 1062 - protein, 11 aa, Branchiostoma floridae
PPSLPAQLKKH

SEQ ID NO: 1063 - protein, 16 aa, Branchiostoma floridae
EEFDISLLLLLLKELV

SEQ ID NO: 1064 - protein, 8 aa, Branchiostoma floridae
GRDAPYSD

SEQ ID NO: 1065 - protein, 13 aa, Branchiostoma floridae
KLGQFRNKNYGHI

SEQ ID NO: 1066 - protein, 13 aa, Branchiostoma floridae
WDELTEILVDLGG

SEQ ID NO: 1067 - protein, 11 aa, Homo sapiens
PPLLKKELLIH

SEQ ID NO: 1068 - protein, 16 aa, Homo sapiens
KQFDLCLLLALIKHLN

SEQ ID NO: 1069 - protein, 8 aa, Homo sapiens
NMEPPSSD

SEQ ID NO: 1070 - protein, 15 aa, Homo sapiens
ILRLCKYRDILLSEI

SEQ ID NO: 1071 - protein, 13 aa, Homo sapiens
WKKVSDILLRLGM

SEQ ID NO: 1072 - protein, 11 aa, Escherichia coli
VTAEKLLVSGL

SEQ ID NO: 1073 - protein, 16 aa, Escherichia coli
LYPELRTIEGVLKSKM

SEQ ID NO: 1074 - protein, 8 aa, Escherichia coli
YILKPQFA

SEQ ID NO: 1075 - protein, 14 aa, Escherichia coli
AYTFFNVERHSLFH

SEQ ID NO: 1076 - protein, 13 aa, Escherichia coli
MISDMARLMGKAT

SEQ ID NO: 1077 - protein, 11 aa, Photobacterium profundum
DTYRSLLSSSY

SEQ ID NO: 1078 - protein, 16 aa, Photobacterium profundum
IYPDLRVLEGVIKEAM

SEQ ID NO: 1079 - protein, 8 aa, Photobacterium profundum
TELKTEYN

SEQ ID NO: 1080 - protein, 14 aa, Photobacterium profundum
CYAYFKAHRHSLFH

SEQ ID NO: 1081 - protein, 13 aa, Photobacterium profundum
TTDTIGEVMQMSE

SEQ ID NO: 1082 - protein, 11 aa, Geobacillus thermoglucosidasius
LYDRDRIEASE

SEQ ID NO: 1083 - protein, 16 aa, Geobacillus thermoglucosidasius
VSGTLRAFEGFFKKLL

SEQ ID NO: 1084 - protein, 8 aa, Geobacillus thermoglucosidasius
DISEKVFN

SEQ ID NO: 1085 - protein, 14 aa, Geobacillus thermoglucosidasius
MLNHMSQDRNPYSH

SEQ ID NO: 1086 - protein, 13 aa, Geobacillus thermoglucosidasius
PLRTLNQAISLHN

SEQ ID NO: 1087 - protein, 12 aa, Teredinibacter turnerae
CRSIRKLLNMNA

SEQ ID NO: 1088 - protein, 16 aa, Teredinibacter turnerae
SYPLIYEIENLVRKLI

SEQ ID NO: 1089 - protein, 9 aa, Teredinibacter turnerae
IQLSNFLFD

SEQ ID NO: 1090 - protein, 15 aa, Teredinibacter turnerae
RWGKLYKLRCKIAHN

SEQ ID NO: 1091 - protein, 13 aa, Teredinibacter turnerae
TTKLVEEVKLKIL

SEQ ID NO: 1092 - protein, 5 aa, Methanococcus maripaludis
FRLMY

SEQ ID NO: 1093 - protein, 16 aa, Methanococcus maripaludis
FLDSVLALEIYHTLKF

SEQ ID NO: 1094 - protein, 10 aa, Methanococcus maripaludis
FINKMKDVFN

SEQ ID NO: 1095 - protein, 15 aa, Methanococcus maripaludis
ICRIIRDTRNKLVHD

SEQ ID NO: 1096 - protein, 13 aa, Methanococcus maripaludis
PYFLIELLKNIFK

SEQ ID NO: 1097 - protein, 11 aa, Novosphingobium pentaromativorans
VHRALSWLRRA

SEQ ID NO: 1098 - protein, 14 aa, Novosphingobium pentaromativorans
FILLWIGFNAAYAG

SEQ ID NO: 1099 - protein, 10 aa, Novosphingobium pentaromativorans
ERSRTAINYA

SEQ ID NO: 1100 - protein, 15 aa, Novosphingobium pentaromativorans
LFDRLYVLRNQLVHG

SEQ ID NO: 1101 - protein, 13 aa, Novosphingobium pentaromativorans
RDQVRDGASLLGC

SEQ ID NO: 1102 - protein, 12 aa, Chlorobium chlorochromatii
IMEQRKAILEPL

SEQ ID NO: 1103 - protein, 16 aa, Chlorobium chlorochromatii
AVAYNHFVPLLAQDLI

SEQ ID NO: 1104 - protein, 6 aa, Chlorobium chlorochromatii
KISNKK

SEQ ID NO: 1105 - protein, 15 aa, Chlorobium chlorochromatii
SEKLKTFRDKYYAHL

SEQ ID NO: 1106 - protein, 13 aa, Chlorobium chlorochromatii
FLGIHRKSANEMW

SEQ ID NO: 1107 - protein, 12 aa, Lactococcus lactis
DAYNKLILLKQY

SEQ ID NO: 1108 - protein, 15 aa, Lactococcus lactis
FFYNNLLDSLVIAIF

SEQ ID NO: 1109 - protein, 6 aa, Lactococcus lactis
NYTNFP

SEQ ID NO: 1110 - protein, 15 aa, Lactococcus lactis
LEYLYAQRNKIYVHN

SEQ ID NO: 1111 - protein, 13 aa, Lactococcus lactis
NYAWEPTNINDWE

SEQ ID NO: 1112 - protein, 16 aa, Escherichia coli
ESVIAHMNELLIALSD

SEQ ID NO: 1113 - protein, 15 aa, Escherichia coli
RYTQQQRLRTAIAHH

SEQ ID NO: 1114 - protein, 12 aa, Escherichia coli
EARHEQLTKGGT

SEQ ID NO: 1115 - protein, 16 aa, Cronobacter sakazakii
QHVIAPMNELLIALSD

SEQ ID NO: 1116 - protein, 15 aa, Cronobacter sakazakii
RYDLQQQLRTAIAHH

SEQ ID NO: 1117 - protein, 13 aa, Cronobacter sakazakii
AAERLAELTRGGT

SEQ ID NO: 1118 - protein, 16 aa, Homo sapiens
ESRYRTLRNVGNESDI

SEQ ID NO: 1119 - protein, 10 aa, Homo sapiens
LQPGPSEHSK

SEQ ID NO: 1120 - protein, 14 aa, Homo sapiens
VGDLLKFIRNLGEH

SEQ ID NO: 1121 - protein, 13 aa, Homo sapiens
IGDPSLYFQKTFP

SEQ ID NO: 1122 - protein, 16 aa, Arabidopsis thaliana
EMRLSFLRDASDRVEL

SEQ ID NO: 1123 - protein, 10 aa, Arabidopsis thaliana
MESTAPVAIG

SEQ ID NO: 1124 - protein, 15 aa, Arabidopsis thaliana
IRDLLRVIRNKLNHH

SEQ ID NO: 1125 - protein, 13 aa, Arabidopsis thaliana
PEGFDEYFAVRFP

SEQ ID NO: 1126 - protein, 12 aa, Helicobacter pylori
YELLWQEVIRAK

SEQ ID NO: 1127 - protein, 15 aa, Helicobacter pylori
WVSLQNVMRRIIEYY

SEQ ID NO: 1128 - protein, 5 aa, Helicobacter pylori
FRILG

SEQ ID NO: 1129 - protein, 17 aa, Helicobacter pylori
KQVFSSFISWFNDGSHG

SEQ ID NO: 1130 - protein, 13 aa, Helicobacter pylori
IETYLKVFENIFK

SEQ ID NO: 1131 - protein, 12 aa, Streptococcus mutans
HLMLVDELKKAI

SEQ ID NO: 1132 - protein, 15 aa, Streptococcus mutans
EKYHFNLLRNLLEKT

SEQ ID NO: 1133 - protein, 5 aa, Streptococcus mutans
ATFLG

SEQ ID NO: 1134 - protein, 14 aa, Streptococcus mutans
PAPYIRRINLHSHS

SEQ ID NO: 1135 - protein, 13 aa, Streptococcus mutans
KKVLERVFNQFLQ

SEQ ID NO: 1136 - protein, 12 aa, Escherichia coli
HLHLKQTIEQAI

SEQ ID NO: 1137 - protein, 15 aa, Escherichia coli
ERYHFTLLRNLYEKT

SEQ ID NO: 1138 - protein, 5 aa, Escherichia coli
ASFLG

SEQ ID NO: 1139 - protein, 13 aa, Escherichia coli
LYLSRIINFTSHS

SEQ ID NO: 1140 - protein, 13 aa, Escherichia coli
KATVKLLLDHLKN

SEQ ID NO: 1141 - protein, 12 aa, Bacteroides fragilis
KEIEEERTVQNI

SEQ ID NO: 1142 - protein, 16 aa, Bacteroides fragilis
TSFGEVTEEYHDELYS

SEQ ID NO: 1143 - protein, 8 aa, Bacteroides fragilis
YIKELSNG

SEQ ID NO: 1144 - protein, 15 aa, Bacteroides fragilis
QKTLTEKIRHQIHHP

SEQ ID NO: 1145 - protein, 13 aa, Bacteroides fragilis
ETEIRQSIEDMRA

SEQ ID NO: 1146 - protein, 12 aa, Methylobacillus flagellates
SNQIPTRVSPVL

SEQ ID NO: 1147 - protein, 16 aa, Methylobacillus flagellates
SAFGEASYEYHNELYG

SEQ ID NO: 1148 - protein, 8 aa, Methylobacillus flagellates
YNRLRRDG

SEQ ID NO: 1149 - protein, 15 aa, Methylobacillus flagellates
QVILTEYIRHQIHHP

SEQ ID NO: 1150 - protein, 13 aa, Methylobacillus flagellates
TAELTESIETMRL

SEQ ID NO: 1151 - protein, 12 aa, Campylobacter hominis
KDGEQKKEVKNV

SEQ ID NO: 1152 - protein, 16 aa, Campylobacter hominis
MAFGEITEEYHNELYG

SEQ ID NO: 1153 - protein, 8 aa, Campylobacter hominis
YKKLKKDG

SEQ ID NO: 1154 - protein, 15 aa, Campylobacter hominis
KLTLTEYIRHQIHHP

SEQ ID NO: 1155 - protein, 13 aa, Campylobacter hominis
LSELKDSIEMMRN

SEQ ID NO: 1156 - protein, 15 aa, Homo sapiens
IPDWIVDLRHELTHK

SEQ ID NO: 1157 - protein, 15 aa, Mycobacterium tuberculosis
LGRFESRVRNTAAHE

SEQ ID NO: 1158 - protein, 15 aa, Lactococcus lactis
WIRAGWFIRNRSAHY

SEQ ID NO: 1159 - protein, 15 aa, Thermus thermophilus
  MOD_RES (5)..(5): Any amino acid
LALGXVDDRSLTVHT

SEQ ID NO: 1160 - protein, 22 aa, Unknown
  Synthetic
  source (1)..(22): /note="Description of Unknown: Lachnospiraceae bacterium sequence"
LKSMLYSMRNSSFHFSTENVDN

SEQ ID NO: 1161 - protein, 22 aa, Unknown
  Synthetic
  source (1)..(22): /note="Description of Unknown: Lachnospiraceae bacterium sequence"
LKDVIYSMRNDSFHYATENHNN

SEQ ID NO: 1162 - protein, 22 aa, Clostridium aminophilum
LRKAIYSLRNETFHFTTLNKGS

SEQ ID NO: 1163 - protein, 22 aa, Unknown
  Synthetic
  source (1)..(22): /note="Description of Unknown: Lachnospiraceae bacterium sequence"
IIQIIYSLRNKSFHFKTYDHGD

SEQ ID NO: 1164 - protein, 22 aa, Carnobacterium gallinarum
LRGSVQQIRNEIFHSFDKNQKF

SEQ ID NO: 1165 - protein, 21 aa, Carnobacterium gallinarum
IRGAVQRVRNQIFHQQINKRH

SEQ ID NO: 1166 - protein, 20 aa, Paludibacter propionicigenes
IRGAVQQIRNNVNHYKKDAL

SEQ ID NO: 1167 - protein, 20 aa, Listeria seeligeri
LRGAIAPIRNEIIHLKKHSW

SEQ ID NO: 1168 - protein, 20 aa, Listeria weihenstephanensis
IRGSIQQIRNEVYHCKKHSW

SEQ ID NO: 1169 - protein, 20 aa, Listeria newyorkensis
IRGSIQQIRNEVYHCKKHSW

SEQ ID NO: 1170 - protein, 21 aa, Leptotrichia wadei
ISYSIYNVRNGVGHFNKLILG

SEQ ID NO: 1171 - protein, 21 aa, Leptotrichia wadei
MLNAITSIRHRVVHYNMNTNS

SEQ ID NO: 1172 - protein, 21 aa, Leptotrichia wadei
IDEAISSIRHGIVHFNLELEG

SEQ ID NO: 1173 - protein, 22 aa, Rhodobacter capsulatus
LLRYLRGCRNQTFHLGARAGFL

SEQ ID NO: 1174 - protein, 21 aa, Leptotrichia buccalis
IDEAISSIRHGIVHFNLELEG

SEQ ID NO: 1175 - protein, 21 aa, Leptotrichia sp.
IDEAISSIRHGIVHFNLELEG

SEQ ID NO: 1176 - protein, 16 aa, Leptotrichia sp.
FQKEGYLLRNKILHNS

SEQ ID NO: 1177 - protein, 15 aa, Leptotrichia shahii
FTKIGTNERNRILHA

SEQ ID NO: 1178 - protein, 14 aa, Unknown
  Synthetic
  source (1)..(14): /note="Description of Unknown: Lachnospiraceae bacterium sequence"
FRNEIDHFHYFYDR

SEQ ID NO: 1179 - protein, 14 aa, Unknown
  Synthetic
  source (1)..(14): /note="Description of Unknown: Lachnospiraceae bacterium sequence"
LRNYIEHFRYYSSF

SEQ ID NO: 1180 - protein, 14 aa, Clostridium aminophilum
VRKYVDHFKYYATS

SEQ ID NO: 1181 - protein, 14 aa, Unknown
  Synthetic
  source (1)..(14): /note="Description of Unknown: Lachnospiraceae bacterium sequence"
LRKYVDHFKYYAYG

SEQ ID NO: 1182 - protein, 14 aa, Carnobacterium gallinarum
IRNQTAHLSVLQLE

SEQ ID NO: 1183 - protein, 14 aa, Carnobacterium gallinarum
IRNNIAHLHVLRND

SEQ ID NO: 1184 - protein, 14 aa, Paludibacter propionicigenes
IRNHIAHFNYLTKD

SEQ ID NO: 1185 - protein, 14 aa, Listeria seeligeri
KRNNISHFNYLNGQ

SEQ ID NO: 1186 - protein, 14 aa, Listeria weihenstephanensis
ARNHIAHLNYLSLK

SEQ ID NO: 1187 - protein, 14 aa, Listeria newyorkensis
ARNHIAHLNYLSLK

SEQ ID NO: 1188 - protein, 14 aa, Leptotrichia wadei
FRNYIAHFLHLHTK

SEQ ID NO: 1189 - protein, 14 aa, Leptotrichia wadei
IRNYIAHFNYIPDA

SEQ ID NO: 1190 - protein, 14 aa, Leptotrichia wadei
IRNYIAHFNYIPHA

SEQ ID NO: 1191 - protein, 14 aa, Rhodobacter capsulatus
TRKDLAHFNVLDRA

SEQ ID NO: 1192 - protein, 14 aa, Leptotrichia buccalis
IRNYIAHFNYIPHA

SEQ ID NO: 1193 - protein, 14 aa, Leptotrichia sp.
IRNYIAHFNYIPNA

SEQ ID NO: 1194 - protein, 14 aa, Leptotrichia sp.
IRNYISHFYIVRNP

SEQ ID NO: 1195 - protein, 14 aa, Leptotrichia shahii
IRNYISHFYIVRNP

SEQ ID NO: 1196 - RNA, 36 nt, Artificial Sequence
  Synthetic
gugccacuucucagaucgcucgcucagugauccgac

SEQ ID NO: 1197 - RNA, 105 nt, Artificial Sequence
  Synthetic
gucagaacacugagcgagcguucuuuuugagaagcucaacgggcuuugccaccuggaaaguggccauuggcacacccguugaaaaaauucuguccucuagacaga

SEQ ID NO: 1198 - RNA, 105 nt, Artificial Sequence; identical to SEQ ID NO: 1197
  Synthetic

SEQ ID NO: 1199 - RNA, 36 nt, Artificial Sequence; identical to SEQ ID NO: 1196
  Synthetic

SEQ ID NO: 1200 - RNA, 37 nt, Artificial Sequence
  Synthetic
gugccaaucacccaacacugaccaagcuugccgagac

SEQ ID NO: 1201 - RNA, 64 nt, Artificial Sequence
  Synthetic
cuuggggaaagcuaggcaaguuuuggaugauaagaaauaaucaugucacaaggagggaguuuuu

SEQ ID NO: 1202 - RNA, 64 nt, Artificial Sequence; identical to SEQ ID NO: 1201
  Synthetic

SEQ ID NO: 1203 - RNA, 37 nt, Artificial Sequence; identical to SEQ ID NO: 1200
  Synthetic

SEQ ID NO: 1204 - RNA, 36 nt, Artificial Sequence; identical to SEQ ID NO: 27
  Synthetic

SEQ ID NO: 1205 - RNA, 75 nt, Artificial Sequence; identical to SEQ ID NO: 28
  Synthetic

SEQ ID NO: 1206 - RNA, 75 nt, Artificial Sequence; identical to SEQ ID NO: 28
  Synthetic

SEQ ID NO: 1207 - RNA, 36 nt, Artificial Sequence; identical to SEQ ID NO: 27
  Synthetic

SEQ ID NO: 1208 - RNA, 36 nt, Artificial Sequence; identical to SEQ ID NO: 30
  Synthetic

SEQ ID NO: 1209 - RNA, 107 nt, Artificial Sequence; identical to SEQ ID NO: 31
  Synthetic

SEQ ID NO: 1210 - RNA, 107 nt, Artificial Sequence; identical to SEQ ID NO: 31
  Synthetic

SEQ ID NO: 1211 - RNA, 36 nt, Artificial Sequence; identical to SEQ ID NO: 30
  Synthetic

SEQ ID NO: 1212 - RNA, 36 nt, Artificial Sequence
  Synthetic
guucgaaagcuuaguggaaagcuucguccuuagcac

SEQ ID NO: 1213 - RNA, 69 nt, Artificial Sequence; identical to SEQ ID NO: 34
  Synthetic

SEQ ID NO: 1214 - RNA, 69 nt, Artificial Sequence; identical to SEQ ID NO: 34
  Synthetic

SEQ ID NO: 1215 - RNA, 36 nt, Artificial Sequence; identical to SEQ ID NO: 33
  Synthetic

SEQ ID NO: 1216 - RNA, 35 nt, Artificial Sequence
  Synthetic
guauugagaaaagccagauauaguuggcaauagac

SEQ ID NO: 1217 - RNA, 62 nt, Artificial Sequence
  Synthetic
auauuuugauucccauuuaugguuauuuaccauaaaugggaaucaacuaaaaaauauuuuuu

SEQ ID NO: 1218 - RNA, 35 nt, Artificial Sequence; identical to SEQ ID NO: 1216
  Synthetic

SEQ ID NO: 1219 - RNA, 62 nt, Artificial Sequence; identical to SEQ ID NO: 1217
  Synthetic

SEQ ID NO: 1220 - RNA, 35 nt, Artificial Sequence
  Synthetic
guugaugagaagagcccaagauagagggcaauaac

SEQ ID NO: 1221 - RNA, 35 nt, Artificial Sequence
  Synthetic
gcuggagaagauagcccaagaaagagggcaauaac

SEQ ID NO: 1222 - RNA, 78 nt, Artificial Sequence
  Synthetic
auuauuaccauuuugguuggaaugcuauuauaaaggaucauucgauuauuaccucuaccucccuucccacgauuucuu

SEQ ID NO: 1223 - DNA, 78 bp, Artificial Sequence
  Synthetic
attattaccattttggttggaatgctattataaaggatcattcgattattacctctacctcccttcccacgatttctt

SEQ ID NO: 1224 - RNA, 35 nt, Artificial Sequence; identical to SEQ ID NO: 1220
  Synthetic

SEQ ID NO: 1225 - DNA, 78 bp, Artificial Sequence; identical to SEQ ID NO: 1223
  Synthetic

SEQ ID NO: 1226 - RNA, 35 nt, Artificial Sequence; identical to SEQ ID NO: 1221
  Synthetic

SEQ ID NO: 1227 - RNA, 35 nt, Artificial Sequence
  Synthetic
guuuggagaacagcccgauauagagggcaauagac

SEQ ID NO: 1228 - RNA, 81 nt, Artificial Sequence
  Synthetic
gucuuacgaccucaguauuaggaagauuucaaccaagaaaacuuaguuucaggcuuaaugaucgagucaugcagccaaagu

SEQ ID NO: 1229 - RNA, 81 nt, Artificial Sequence; identical to SEQ ID NO: 1228
  Synthetic

SEQ ID NO: 1230 - RNA, 35 nt, Artificial Sequence; identical to SEQ ID NO: 1227
  Synthetic

SEQ ID NO: 1231 - RNA, 35 nt, Artificial Sequence; identical to SEQ ID NO: 36
  Synthetic

SEQ ID NO: 1232 - RNA, 36 nt, Artificial Sequence; identical to SEQ ID NO: 37
  Synthetic

SEQ ID NO: 1233 - RNA, 36 nt, Artificial Sequence
  Synthetic
guuauaguccucuuacauuuagagguagucuuuaau

SEQ ID NO: 1234 - RNA, 98 nt, Artificial Sequence
  Synthetic
ucuuaagaacuucucuaccugaaguuggauuauaaaugacucuugcucucauagauauccuccuuugaaaauauacacugccgauuaauuaccguuuu

SEQ ID NO: 1235 - RNA, 98 nt, Artificial Sequence; identical to SEQ ID NO: 1234
  Synthetic

SEQ ID NO: 1236 - RNA, 36 nt, Artificial Sequence; identical to SEQ ID NO: 1233
  Synthetic

SEQ ID NO: 1237 - RNA, 36 nt, Artificial Sequence
  Synthetic
guuauaguccucuuacauuuagagguaguuuauauu

SEQ ID NO: 1238 - RNA, 36 nt, Artificial Sequence
  Synthetic
guuauaguccccuuacauuuagggguagucuuuaau

SEQ ID NO: 1239 - RNA, 102 nt, Artificial Sequence
  Synthetic
aauauaaauucucccuaaauauaagagaauaauaacucaaucucuucauucguauuuugucuaguuaagauaaguaccaccaaauacaaucaauccaaaaaa

SEQ ID NO: 1240 - RNA, 102 nt, Artificial Sequence; identical to SEQ ID NO: 1239
  Synthetic

SEQ ID NO: 1241 - RNA, 36 nt, Artificial Sequence; identical to SEQ ID NO: 1237
  Synthetic

SEQ ID NO: 1242 - RNA, 102 nt, Artificial Sequence; identical to SEQ ID NO: 1239
  Synthetic

SEQ ID NO: 1243 - RNA, 36 nt, Artificial Sequence; identical to SEQ ID NO: 1238
  Synthetic

SEQ ID NO: 1244 - RNA, 36 nt, Artificial Sequence
  Synthetic
guuguaguucccuucaauuuugggauaauccacaag

SEQ ID NO: 1245 - RNA, 36 nt, Artificial Sequence; identical to SEQ ID NO: 39
  Synthetic

SEQ ID NO: 1246 - RNA, 99 nt, Artificial Sequence; identical to SEQ ID NO: 40
  Synthetic

SEQ ID NO: 1247 - RNA, 99 nt, Artificial Sequence; identical to SEQ ID NO: 40
  Synthetic

SEQ ID NO: 1248 - RNA, 36 nt, Artificial Sequence; identical to SEQ ID NO: 39
  Synthetic

SEQ ID NO: 1249 - RNA, 36 nt, Artificial Sequence
  Synthetic
guuuuagaccucuucuauuuugagguacucuaaauc

SEQ ID NO: 1250 - RNA, 36 nt, Artificial Sequence
  Synthetic
guuuuaguccucuuuuguuuugagguacucuaaauc

SEQ ID NO: 1251 - RNA, 147 nt, Artificial Sequence
  Synthetic
aagucagcgcacaacaaagaagaugacgaacaaaaucucucgccaucuucuuaaaauuauuugccacacagccaacauuauaagcguuaaaaccagcaccaugaguacauuucacccaacaaucagaauccccguuucuccguuuuu

SEQ ID NO: 1252 - RNA, 36 nt, Artificial Sequence; identical to SEQ ID NO: 1250
  Synthetic

SEQ ID NO: 1253 - RNA, 147 nt, Artificial Sequence; identical to SEQ ID NO: 1251
  Synthetic

SEQ ID NO: 1254 - RNA, 36 nt, Artificial Sequence
  Synthetic
guuuuagaucccuucguuuuugggguuaucuauauc

SEQ ID NO: 1255 - RNA, 36 nt, Artificial Sequence; identical to SEQ ID NO: 42
  Synthetic

SEQ ID NO: 1256 - RNA, 113 nt, Artificial Sequence; identical to SEQ ID NO: 43
  Synthetic

SEQ ID NO: 1257 - RNA, 70 nt, Artificial Sequence; identical to SEQ ID NO: 44
  Synthetic

SEQ ID NO: 1258 - RNA, 113 nt, Artificial Sequence; identical to SEQ ID NO: 43
  Synthetic

SEQ ID NO: 1259 - RNA, 36 nt, Artificial Sequence; identical to SEQ ID NO: 42
  Synthetic

SEQ ID NO: 1260 - RNA, 70 nt, Artificial Sequence; identical to SEQ ID NO: 44
  Synthetic

SEQ ID NO: 1261 - RNA, 36 nt, Artificial Sequence; identical to SEQ ID NO: 42
  Synthetic

SEQ ID NO: 1262 - RNA, 36 nt, Artificial Sequence; identical to SEQ ID NO: 46
  Synthetic

SEQ ID NO: 1263 - RNA, 95 nt, Artificial Sequence; identical to SEQ ID NO: 47
  Synthetic

SEQ ID NO: 1264 - RNA, 95 nt, Artificial Sequence; identical to SEQ ID NO: 47
  Synthetic

SEQ ID NO: 1265 - RNA, 36 nt, Artificial Sequence; identical to SEQ ID NO: 46
  Synthetic

SEQ ID NO: 1266 - RNA, 36 nt, Artificial Sequence
  Synthetic
guucaguccgccgucgucuuggcggugaugugaggc

SEQ ID NO: 1267 - RNA, 36 nt, Artificial Sequence
  Synthetic
guucaguccgccgucauuuuggcggugaugugcucc

SEQ ID NO: 1268 - RNA, 36 nt, Artificial Sequence; identical to SEQ ID NO: 1266
  Synthetic

SEQ ID NO: 1269 - RNA, 36 nt, Artificial Sequence; identical to SEQ ID NO: 1267
  Synthetic

SEQ ID NO: 1270 - RNA, 36 nt, Artificial Sequence; identical to SEQ ID NO: 1266
  Synthetic

SEQ ID NO: 1271 - RNA, 36 nt, Artificial Sequence; identical to SEQ ID NO: 1267
  Synthetic

SEQ ID NO: 1272 - DNA, 81 bp, Alicyclobacillus acidoterrestris
agcgcccgctgtcggatcactgagcgagcgatctgagaagtggcactgtttggtaaaggtaaaaagacgaatgatgcatcc

SEQ ID NO: 1273 - DNA, 83 bp, Alicyclobacillus acidoterrestris
tgatgcatccgtcggatcactgagcgagcgatctgagaagtggcaccctttataaaaaggggcgtcctttagtaccgtgtact

SEQ ID NO: 1274 - DNA, 84 bp, Alicyclobacillus acidoterrestris
accgtgtactgtcggatcactgagcgagcgatctgagaagtggcacaagccttgagtaattcgccgtgggattccccgccgtat

SEQ ID NO: 1275 - DNA, 80 bp, Alicyclobacillus acidoterrestris
cccgccgtatgtcggatcactgagcgagcgatctgagaagtggcactaatgaagttaaaggagatgagacaatgaaagaa

SEQ ID NO: 1276 - DNA, 83 bp, Alicyclobacillus acidoterrestris
aatgaaagaagtcggatcactgagcgagcgatctgagaagtggcactgcaatgcgttggattatgacgatgcaggccaaggaa

SEQ ID NO: 1277 - DNA, 56 bp, Alicyclobacillus acidoterrestris
ggccaaggaagtcggatcactgagcgagcgatctgagaagtggcactgatgtcagc

SEQ ID NO: 1278 - DNA, 36 bp, Alicyclobacillus acidoterrestris
gtcggatcactgagcgagcgatctgagaagtggcac

SEQ ID NO: 1279 - DNA, 36 bp, Alicyclobacillus acidoterrestris; identical to SEQ ID NO: 1278

SEQ ID NO: 1280 - DNA, 84 bp, Desulfonatronum thiodismutans
ccggctcgaggtctcggcaagcttggtcagtgttgggtgattggcacatccaggtggttggatgcgggacataccttccgcctt

SEQ ID NO: 1281 - DNA, 84 bp, Desulfonatronum thiodismutans
cttccgccttgtctcggcaagcttggtcagtgttgggtgattggcactgcttcccggcgaacggcgagctgacctcctagatgt

SEQ ID NO: 1282 - DNA, 83 bp, Desulfonatronum thiodismutans
tcctagatgtgtctcggcaagcttggtcagtgttgggtgattggcaccgtctgctcggtctcggacttcaccaccacgtccac

SEQ ID NO: 1283 - DNA, 83 bp, Desulfonatronum thiodismutans
ccacgtccacgtctcggcaagcttggtcagtgttgggtgattggcacgggtgcggcatttgcgggtgttgggggagtggcagg

SEQ ID NO: 1284 - DNA, 37 bp, Desulfonatronum thiodismutans
gtctcggcaagcttggtcagtgttgggtgattggcac

SEQ ID NO: 1285 - DNA, 15 bp, Desulfonatronum thiodismutans
gtctcggcaagcttg

SEQ ID NO: 1286 - DNA, 22 bp, Desulfonatronum thiodismutans
gtcagtgttgggtgattggcac

SEQ ID NO: 1287 - DNA, 80 bp, Unknown
  Synthetic
  source (1)..(80): /note="Description of Unknown: Opitutaceae bacterium sequence"
acatccactgccgcctgacgattcgtgaaacggcattcgctgcggcaatagtctctggaaatgttatagtagctcctaca

SEQ ID NO: 1288 - DNA, 81 bp, Unknown
  Synthetic
  source (1)..(81): /note="Description of Unknown: Opitutaceae bacterium sequence"
agctcctacaccgcctgacgattcgtgaaacggcattcgctgcggcaagaaaaagagtcgtggtgttggcgcgggtcagac

SEQ ID NO: 1289 - DNA, 80 bp, Unknown
  Synthetic
  source (1)..(80): /note="Description of Unknown: Opitutaceae bacterium sequence"
cgggtcagacccgcctgacgattcgtgaaacggcattcgctgcggcaatgtaacgcctggagcatggcttgacccgaacc

SEQ ID NO: 1290 - DNA, 82 bp, Unknown
  Synthetic
  source (1)..(82): /note="Description of Unknown: Opitutaceae bacterium sequence"
gacccgaaccccgcctgacgattcgtgaaacggcattcgctgcggcaatatacgtctgattaaaggtatgggattccctgtt

SEQ ID NO: 1291 - DNA, 80 bp, Unknown
  Synthetic
  source (1)..(80): /note="Description of Unknown: Opitutaceae bacterium sequence"
attccctgttccgcctgacgattcgtgaaacggcattcgctgcggctctcagtcaattcgaatatgatgcggggtactgg

SEQ ID NO: 1292 - DNA, 80 bp, Unknown
  Synthetic
  source (1)..(80): /note="Description of Unknown: Opitutaceae bacterium sequence"
ggggtactggccgcctgacgattcgtgaaacggcattcgctgcggcgctccacaaaagcgattatcatttcccggttata

SEQ ID NO: 1293 - DNA, 82 bp, Unknown
  Synthetic
  source (1)..(82): /note="Description of Unknown: Opitutaceae bacterium sequence"
cccggttataccgcctgacgattcgtgaaacggcattcgctgcggcgtgcccggccatgcggttatcggtctcgatggcctt

SEQ ID NO: 1294 - DNA, 79 bp, Unknown
  Synthetic
  source (1)..(79): /note="Description of Unknown: Opitutaceae bacterium sequence"
cgatggccttccgcctgacgattcgtgaaacggcattcgctgcggctcgcggggaaacgagtgcgtagtcgatcgtcac

SEQ ID NO: 1295 - DNA, 79 bp, Unknown
  Synthetic
  source (1)..(79): /note="Description of Unknown: Opitutaceae bacterium sequence"
cgatcgtcacccgcctgacgattcgtgaaacggcattcgctgcggcgtagctgtcgccgtctttcttgtattctttttt

SEQ ID NO: 1296 - DNA, 82 bp, Unknown
  Synthetic
  source (1)..(82): /note="Description of Unknown: Opitutaceae bacterium sequence"
attcttttttccgcctgacgattcgtgaaacggcattcgctgcggcgatcggacaatcacgccagacattgccggtcatgat

SEQ ID NO: 1297 - DNA, 83 bp, Unknown
  Synthetic
  source (1)..(83): /note="Description of Unknown: Opitutaceae bacterium sequence"
cggtcatgatccgcctgacgattcgtgaaacggcattcgctgcggcttggcgaccttcaggcgagcgttattggcggcataga

SEQ ID NO: 1298 - DNA, 81 bp, Unknown
  Synthetic
  source (1)..(81): /note="Description of Unknown: Opitutaceae bacterium sequence"
gcggcatagaccgcctgacgattcgtgaaacggcattcgctgcggcaaaaatggcgaaaccgaagccgccgacgcgataca

SEQ ID NO: 1299 - DNA, 80 bp, Unknown
  Synthetic
  source (1)..(80): /note="Description of Unknown: Opitutaceae bacterium sequence"
acgcgatacaccgcctgacgattcgtgaaacggcattcgctgcggcatgtcaattttggtaacacttcgccttggcacca

SEQ ID NO: 1300 - DNA, 80 bp, Unknown
  Synthetic
  source (1)..(80): /note="Description of Unknown: Opitutaceae bacterium sequence"
cttggcaccaccgcctgacgattcgtgaaacggcattcgctgcggcatgtcaattttggtaacacttcgccttggcacca

SEQ ID NO: 1301 - DNA, 80 bp, Unknown
  Synthetic
  source (1)..(80): /note="Description of Unknown: Opitutaceae bacterium sequence"
cttggcaccaccgcctgacgattcgtgaaacggcattcgctgcggcagcacgtggggtttttgctctcacaaagtaaatt

SEQ ID NO: 1302 - DNA, 79 bp, Unknown
  Synthetic
  source (1)..(79): /note="Description of Unknown: Opitutaceae bacterium sequence"
aaagtaaattccgcctgacgattcgtgaaacggcattcgctgcggcatagcatcggcgagtgtgtctgacagtcctact

SEQ ID NO: 1303 - DNA, 83 bp, Unknown
  Synthetic
  source (1)..(83): /note="Description of Unknown: Opitutaceae bacterium sequence"
cagtcctactccgcctgacgattcgtgaaacggcattcgctgcggcggcgaaccctcgtcaaccgcgacctcaagatggcaca

SEQ ID NO: 1304 - DNA, 81 bp, Unknown
  Synthetic
  source (1)..(81): /note="Description of Unknown: Opitutaceae bacterium sequence"
agatggcacaccgcctgacgattcgtgaaacggcattcgctgcggcaacgcatcacgcgcctccggctccatttccttgcc

SEQ ID NO: 1305 - DNA, 80 bp, Unknown
  Synthetic
  source (1)..(80): /note="Description of Unknown: Opitutaceae bacterium sequence"
tttccttgccccgcctgacgattcgtgaaacggcattcgctgcggctccgctcacaggggcaatctacgctcaggagatg

SEQ ID NO: 1306 - DNA, 81 bp, Unknown
  Synthetic
  source (1)..(81): /note="Description of Unknown: Opitutaceae bacterium sequence"
tcaggagatgccgcctgacgattcgtgaaacggcattcgctgcggcgaaaacgccccgaaacacagttcccgaattcaaat

SEQ ID NO: 1307 - DNA, 79 bp, Unknown
  Synthetic
  source (1)..(79): /note="Description of Unknown: Opitutaceae bacterium sequence"
gaattcaaatccgcctgacgattcgtgaaacggcattcgctgcggcagcacaattccgagaaacggtttcaggatcata

SEQ ID NO: 1308 - DNA, 81 bp, Unknown
  Synthetic
  source (1)..(81): /note="Description of Unknown: Opitutaceae bacterium sequence"
caggatcataccgcctgacgattcgtgaaacggcattcgctgcggcgccagcgttccctgcgatgctgttgcgaaatcccc

SEQ ID NO: 1309 - DNA, 80 bp, Unknown
  Synthetic
  source (1)..(80): /note="Description of Unknown: Opitutaceae bacterium sequence"
cgaaatccccccgcctgacgattcgtgaaacggcattcgctgcggcttgcactgcgtggtgaaagagttcaaagcgtcca

SEQ ID NO: 1310 - DNA, 56 bp, Unknown
  Synthetic
  source (1)..(56): /note="Description of Unknown: Opitutaceae bacterium sequence"
aaagcgtccaccgcctgacgattcgtgaaacggcattcgctgcggcccgtgctcgc

SEQ ID NO: 1311 - DNA, 36 bp, Unknown
  Synthetic
  source (1)..(36): /note="Description of Unknown: Opitutaceae bacterium sequence"
ccgcctgacgattcgtgaaacggcattcgctgcggc

SEQ ID NO: 1312 - DNA, 36 bp, Unknown; identical to SEQ ID NO: 1311
  Synthetic
  source (1)..(36): /note="Description of Unknown: Opitutaceae bacterium sequence"

SEQ ID NO: 1313 - DNA, 10 bp, Unknown
  Synthetic
  source (1)..(10): /note="Description of Unknown: Opitutaceae bacterium sequence"
ccgcctgacg

SEQ ID NO: 1314 - DNA, 12 bp, Unknown
  Synthetic
  source (1)..(12): /note="Description of Unknown: Opitutaceae bacterium sequence"
attcgtgaaacg

SEQ ID NO: 1315 - DNA, 14 bp, Unknown
  Synthetic
  source (1)..(14): /note="Description of Unknown: Opitutaceae bacterium sequence"
gcattcgctgcggc

SEQ ID NO: 1316 - DNA, 10 bp, Unknown
  Synthetic
  source (1)..(10): /note="Description of Unknown: Opitutaceae bacterium sequence"
ccgcctgacg

SEQ ID NO: 1317 - DNA, 12 bp, Unknown
  Synthetic
  source (1)..(12): /note="Description of Unknown: Opitutaceae bacterium sequence"
attcgtgaaacg

SEQ ID NO: 1318 - DNA, 14 bp, Unknown
  Synthetic
  source (1)..(14): /note="Description of Unknown: Opitutaceae bacterium sequence"
gcattcgctgcggc

SEQ ID NO: 1319 - DNA, 36 bp, Unknown; identical to SEQ ID NO: 1311
  Synthetic
  source (1)..(36): /note="Description of Unknown: Opitutaceae bacterium sequence"

SEQ ID NO: 1320 - DNA, 10 bp, Unknown
  Synthetic
  source (1)..(10): /note="Description of Unknown: Opitutaceae bacterium sequence"
ccgcctgacg

SEQ ID NO: 1321 - DNA, 12 bp, Unknown
  Synthetic
  source (1)..(12): /note="Description of Unknown: Opitutaceae bacterium sequence"
attcgtgaaacg

SEQ ID NO: 1322 - DNA, 14 bp, Unknown
  Synthetic
  source (1)..(14): /note="Description of Unknown: Opitutaceae bacterium sequence"
gcattcgctgcggc

SEQ ID NO: 1323 - DNA, 36 bp, Unknown; identical to SEQ ID NO: 1311
  Synthetic
  source (1)..(36): /note="Description of Unknown: Opitutaceae bacterium sequence"

SEQ ID NO: 1324 - DNA, 10 bp, Unknown
  Synthetic
  source (1)..(10): /note="Description of Unknown: Opitutaceae bacterium sequence"
ccgcctgacg

SEQ ID NO: 1325 - DNA, 12 bp, Unknown
  Synthetic
  source (1)..(12): /note="Description of Unknown: Opitutaceae bacterium sequence"
attcgtgaaacg

SEQ ID NO: 1326 - DNA, 14 bp, Unknown
  Synthetic
  source (1)..(14): /note="Description of Unknown: Opitutaceae bacterium sequence"
gcattcgctgcggc

SEQ ID NO: 1327 - DNA, 81 bp, Bacillus thermoamylovorans
accccctgcggtccaagaaaaaagaaatgatacgaggcattagcaccatgcaaacggattgttatataaatcttcttgaac

SEQ ID NO: 1328 - DNA, 82 bp, Bacillus thermoamylovorans
cttcttgaacgtccaagaaaaaagaaatgatacgaggcattagcacattgttccggcggctaatttgtctgcggtaatcgaa

SEQ ID NO: 1329 - DNA, 87 bp, Bacillus thermoamylovorans
ggtaatcgaagtccaagaaaaaagaaatgatacgaggcattagcaccttcgccatcctcatcccttatcagttgattgcctagcgtt

SEQ ID NO: 1330 - DNA, 83 bp, Bacillus thermoamylovorans
gcctagcgttgtccaagaaaaaagaaatgatacgaggcattagcacacacagaaaccaaatgggaacacgttttcgttaataa

SEQ ID NO: 1331 - DNA, 84 bp, Bacillus thermoamylovorans
tcgttaataagtccaagaaaaaagaaatgatacgaggcattagcacgacattaaaaaattccaaccaagcgagttattgagtgg

SEQ ID NO: 1332 - DNA, 80 bp, Bacillus thermoamylovorans
tattgagtgggtccaagaaaaaagaaatgatacgaggcattagcacttatgagcttaaaagcttgttagcgacattaaac

SEQ ID NO: 1333 - DNA, 83 bp, Bacillus thermoamylovorans
gacattaaacgtccaagaaaaaagaaatgatacgaggcattagcacgttttgttacagctttattccttacttgatcgactct

SEQ ID NO: 1334 - DNA, 83 bp, Bacillus thermoamylovorans
gatcgactctgtccaagaaaaaagaaatgatacgaggcattagcaccagaacctatctcaagaggatgcattctggaaaggaa

SEQ ID NO: 1335 - DNA, 86 bp, Bacillus thermoamylovorans
tggaaaggaagtccaagaaaaaagaaatgatacgaggcattagcaccttataacaataatttaaaagcaatttatgactgtataga

SEQ ID NO: 1336 - DNA, 82 bp, Bacillus thermoamylovorans
actgtatagagtccaagaaaaaagaaatgatacgaggcattagcacttttaagggacatcagaaacactataagctcacttg

SEQ ID NO: 1337 - DNA, 81 bp, Bacillus thermoamylovorans
agctcacttggtccaagaaaaaagaaatgatacgaggcattagcacataatcgactttgcatttctatagtgtcgttcatc

SEQ ID NO: 1338 - DNA, 85 bp, Bacillus thermoamylovorans
gtcgttcatcgtccaagaaaaaagaaatgatacgaggcattagcacaaaatggaacaaggaacaatagacgtttataagtatgga

SEQ ID NO: 1339 - DNA, 83 bp, Bacillus thermoamylovorans
taagtatggagtccaagaaaaaagaaatgatacgaggcattagcactttcaataaagcatcaaactctttttgcattttttca

SEQ ID NO: 1340 - DNA, 83 bp, Bacillus thermoamylovorans
cattttttcagtccaagaaaaaagaaatgatacgaggcattagcacaccgagtaaggaatcgtttaatcaacaaacttgaaac

SEQ ID NO: 1341 - DNA, 84 bp, Bacillus thermoamylovorans
aacttgaaacgtccaagaaaaaagaaatgatacgaggcattagcacggtagtcggcggctaagtgtcgcagggttaacaccgat

SEQ ID NO: 1342 - DNA, 85 bp, Bacillus thermoamylovorans
taacaccgatgtccaagaaaaaagaaatgatacgaggcattagcacacgctgaacaaaactcacgaaaccaaaagtttataaaat

SEQ ID NO: 1343 - DNA, 81 bp, Bacillus thermoamylovorans
tttataaaatgtccaagaaaaaagaaatgatacgaggcattagcacggaaaggatttactagatctcgcaagaaaggtaac

SEQ ID NO: 1344 - DNA, 82 bp, Bacillus thermoamylovorans
gaaaggtaacgtccaagaaaaaagaaatgatacgaggcattagcacatttagtatattgttgttttcatttgcttttttcgc

SEQ ID NO: 1345 - DNA, 83 bp, Bacillus thermoamylovorans
cttttttcgcgtccaagaaaaaagaaatgatacgaggcattagcacttataccgtaaaaaattttggatttgatgtcaccgtc

SEQ ID NO: 1346 - DNA, 82 bp, Bacillus thermoamylovorans
tgtcaccgtcgtccaagaaaaaagaaatgatacgaggcattagcacagaacacaaaaagcggaaaaattgcacttattttcg

SEQ ID NO: 1347 - DNA, 82 bp, Bacillus thermoamylovorans
cttattttcggtccaagaaaaaagaaatgatacgaggcattagcacaatactcgtctacaaactttttctgcttttctgtta

SEQ ID NO: 1348 - DNA, 84 bp, Bacillus thermoamylovorans
ttttctgttagtccaagaaaaaagaaatgatacgaggcattagcaccatacaggacacttaaactctactttacgattttcaaa

SEQ ID NO: 1349 - DNA, 82 bp, Bacillus thermoamylovorans
gattttcaaagtccaagaaaaaagaaatgatatgaggcattagcacgatttaaaacttcttctggcatccagtacatagatt

SEQ ID NO: 1350 - DNA, 82 bp, Bacillus thermoamylovorans
tacatagattgtccaagaaaaaagaaatgatatgaggcattagcacgaaaaaactgtttccttatcacacctatagcaataa

SEQ ID NO: 1351 - DNA, 84 bp, Bacillus thermoamylovorans
atagcaataagtccaagaaaaaagaaatgatatgaggcattagcactctagatatgttcaagaaaatatgcagtctatcggtca

SEQ ID NO: 1352 - DNA, 85 bp, Bacillus thermoamylovorans
ctatcggtcagtccaagaaaaaagaaatgatatgaggcattagcacgaatcaattaatccaatttgttgcaacttaggtagagag

SEQ ID NO: 1353 - DNA, 84 bp, Bacillus thermoamylovorans
aggtagagaggtccaagaaaaaagaaatgatatgaggcattagcacccgaattagcatcgtaccaattacatccatatgatgct

SEQ ID NO: 1354 - DNA, 82 bp, Bacillus thermoamylovorans
atatgatgctgtccaagaaaaaagaaatgatatgaggcattagcacttttctatttttatattactgtttgtttggtgataa

SEQ ID NO: 1355 - DNA, 84 bp, Bacillus thermoamylovorans
ttggtgataagtccaagaaaaaagaaatgatatgaggcattagcactgaatctaaccaaggaagaaataaaagatatttataag

SEQ ID NO: 1356 - DNA, 81 bp, Bacillus thermoamylovorans
tatttataaggtccaagaaaaaagaaatgatatgaggcattagcacaaaaaggagtgtttcaaaatggcaaatgaaaaaag

SEQ ID NO: 1357 - DNA, 82 bp, Bacillus thermoamylovorans
atgaaaaaaggtccaagaaaaaagaaatgatatgaggcattagcacagcttggattgaatcaaacaatggtggtcgaggttt

SEQ ID NO: 1358 - DNA, 82 bp, Bacillus thermoamylovorans
gtcgaggtttgtccaagaaaaaagaaatgatatgaggcattagcacttgagttgtaattaatcaccgttctacctgaaaact

SEQ ID NO: 1359 - DNA, 80 bp, Bacillus thermoamylovorans
cctgaaaactgtccaagaaaaaagaaatgatatgaggcattagcactagatgttgaaaacggcggttttgtctattatcc

SEQ ID NO: 1360 - DNA, 84 bp, Bacillus thermoamylovorans
tctattatccgtccaagaaaaaagaaatgatatgaggcattagcacaaacccgcaaaaaataagctgttgacgagtctagttag

SEQ ID NO: 1361 - DNA, 85 bp, Bacillus thermoamylovorans
gtctagttaggtccaagaaaaaagaaatgatacgaggcattagcacttgtcaatcctcgaaaatgccgggcggacgggcttgcca

SEQ ID NO: 1362 - DNA, 81 bp, Bacillus thermoamylovorans
gggcttgccagtccaagaaaaaagaaatgaaacgaggcattagcacccaccaccgacggcgtccacgccaattgcctgctt

SEQ ID NO: 1363 - DNA, 72 bp, Bacillus thermoamylovorans
ttgcctgcttgtccaagaaaaaagaaatgatacgaggcattagcacaacaatataaacgactactttaccgt

SEQ ID NO: 1364 - DNA, 56 bp, Bacillus thermoamylovorans
actttaccgtgttcaagaaaaaagaaatgatatgaggcattagcacgatgggatgg

SEQ ID NO: 1365 - DNA, 36 bp, Bacillus thermoamylovorans
gtccaagaaaaaagaaatgatacgaggcattagcac

SEQ ID NO: 1366 - DNA, 36 bp, Bacillus thermoamylovorans; identical to SEQ ID NO: 1365

SEQ ID NO: 1367 - DNA, 36 bp, Bacillus thermoamylovorans; identical to SEQ ID NO: 1365

SEQ ID NO: 1368 - DNA, 83 bp, Bacillus sp.
ggactttagcgtgctaaccacgaagctttccactaagctttcgaacaccggattggtggaaagacgccgctgccgaccgaaaa

SEQ ID NO: 1369 - DNA, 83 bp, Bacillus sp.
cgaccgaaaagtgctaaccacgaagctttccactaagctttcgaacaccggattggtggaaagacgccgctgccgaccgaaaa

SEQ ID NO: 1370 - DNA, 87 bp, Bacillus sp.
cgaccgaaaagtgctaaccacgaagctttccactaagctttcgaacgggaaaacgtgggcgcaactttgctattctggcatgtttgc

SEQ ID NO: 1371 - DNA, 83 bp, Bacillus sp.
gcatgtttgcgtgctaaccacgaagctttccactaagctttcgaacaagtttggaagggggcgatagcgatgggttttaagat

SEQ ID NO: 1372 - DNA, 81 bp, Bacillus sp.
gttttaagatgtgctaaccacgaagctttccactaagctttcgaacccgatcaccgtcaaaaccgtagtagtaagactcgc

SEQ ID NO: 1373 - DNA, 81 bp, Bacillus sp.
taagactcgcgtgctaaccacgaagctttccactaagctttcgaacaaggcggcctaaatcacttgggccgcccttaagat

SEQ ID NO: 1374 - DNA, 86 bp, Bacillus sp.
cccttaagatgtgctaaccacgaagctttccactaagctttcgaactgcttttatttccatgctaccattggctgaatcgggactg

SEQ ID NO: 1375 - DNA, 82 bp, Bacillus sp.
atcgggactggtgctaaccacgaagctttccactaagctttcgaacaaacaggtatctgcttatcaacgtgcagcacaggcg

SEQ ID NO: 1376 - DNA, 82 bp, Bacillus sp.
agcacaggcggtgctaaccacgaagctttccactaagctttcgaacctatatgagtagaacgtctctcaataagcgtagaat

SEQ ID NO: 1377 - DNA, 81 bp, Bacillus sp.
agcgtagaatgtgctaaccacgaagctttccactaagctttcgaacgcgccttgttgctatcattagggtcgcgatcaaca

SEQ ID NO: 1378 - DNA, 88 bp, Bacillus sp.
gcgatcaacagtgctaaccacgaagctttccactaagctttcgaacgtataacttttagataacaaatgttatacaaaatgcttgacg

SEQ ID NO: 1379 - DNA, 81 bp, Bacillus sp.
atgcttgacggtgctaaccacgaagctttccactaagctttcgaacagcccaagctttacatacacctatgcgtatgcttt

SEQ ID NO: 1380 - DNA, 56 bp, Bacillus sp.
cgtatgctttgtgctaaccacgaagctttccactaagctttcgaactccttcccac

SEQ ID NO: 1381 - DNA, 36 bp, Bacillus sp.
gtgctaaccacgaagctttccactaagctttcgaac

SEQ ID NO: 1382 - DNA, 84 bp, Bacillus sp.
tggacaagctgtgctaaccacgaagctttccactaagctttcgaacctctggtgtaaggcggtttcttgcttgtaagtgcgcgg

SEQ ID NO: 1383 - DNA, 84 bp, Bacillus sp.
aagtgcgcgggtgctaatcccgaagctttccactaagctttcgaacaaaagagtataagtaccactcttagccgagtagttcaa

SEQ ID NO: 1384 - DNA, 80 bp, Bacillus sp.
agtagttcaagtgctaatcccgaagctttccactaagctttcgaacactggagaaccttccaagtgtgcgatagcgtatc

SEQ ID NO: 1385 - DNA, 80 bp, Bacillus sp.
atagcgtatcgtgctaatcccgaagctttccactaagctttcgaacttttttgttccgccaaggtaaaacgtaccgagtt

SEQ ID NO: 1386 - DNA, 83 bp, Bacillus sp.
gtaccgagttgtgctaatcccgaagctttccactaagctttcgaactttccgtaaaactttttgagaaaacaggagggcgact

SEQ ID NO: 1387 - DNA, 86 bp, Bacillus sp.
gagggcgactgtgctaatcccgaagctttccactaagctttcgaaccaggctttttgtgcataggtcatgcagtaacctaatccgc

SEQ ID NO: 1388 - DNA, 85 bp, Bacillus sp.
cctaatccgcgtgctaatcccgaagctttccactaagctttcgaacgaccatgatctcgaaaagaaaattacgcgtgcatcgcaa

SEQ ID NO: 1389 - DNA, 84 bp, Bacillus sp.
tgcatcgcaagtgctaatcccgaagctttccactaagctttcgaactgggccgctccgattcgataaagacgggtatctggaga

SEQ ID NO: 1390 - DNA, 56 bp, Bacillus sp.
tatctggagagtgctaatcccgaagctttccactaagctttcgaaccagggtaccc

SEQ ID NO: 1391 - DNA, 36 bp, Bacillus sp.
gtgctaatcccgaagctttccactaagctttcgaac

SEQ ID NO: 1392 - DNA, 82 bp, Bacillus sp.
gctacctctggtacatccccttcaatttccactaagctttcgaacgttcggcgtagtagtgtacacgctcttgaatatgatg

SEQ ID NO: 1393 - DNA, 81 bp, Bacillus sp.
gaatatgatggtacatccccttcaatttccactaagctttcgaacgccgcaacgtgctccgggagaggcgcacgttcagag

SEQ ID NO: 1394 - DNA, 80 bp, Bacillus sp.
acgttcagaggtacatccccttcaatttccactaagctttcgaacgcgaccagtccgagcagggcaatcccgacaatgcg

SEQ ID NO: 1395 - DNA, 81 bp, Bacillus sp.
cgacaatgcggtacatccccttcaatttccactaagctttcgaacaacccgaaggactacaccatttcccgtgataaagcg

SEQ ID NO: 1396 - DNA, 81 bp, Bacillus sp.
tgataaagcggtacatccccttcaatttccactaagctttcgaacaaaagcttggggagggcttcgagtcgggtatacagg

SEQ ID NO: 1397 - DNA, 79 bp, Bacillus sp.
ggtatacagggtacatccccttcaatttccactaagctttcgaacccttgtccgcgataaatctgtacgtcgaatccgt

SEQ ID NO: 1398 - DNA, 81 bp, Bacillus sp.
tcgaatccgtgtacatccccttcaatttccactaagctttcgaactgtttggttgctgcgcggccgaagttgtctgacagt

SEQ ID NO: 1399 - DNA, 84 bp, Bacillus sp.
gtctgacagtgtacatccccttcaatttccactaagctttcgaacccgttattaagttacctctttctagcataacctgagtgt

SEQ ID NO: 1400 - DNA, 88 bp, Bacillus sp.
acctgagtgtgtacatccccttcaatttccactaagctttcgaacatgtacatcctgcatcagttcgaaggaagcgggatcagctagt

SEQ ID NO: 1401 - DNA, 86 bp, Bacillus sp.
atcagctagtgtacatccccttcaatttccactaagctttcgaaccaagagacgtgttgacgatcatcttttttgagatctgccgt

SEQ ID NO: 1402 - DNA, 87 bp, Bacillus sp.
gatctgccgtgtacatccccttcaatttccactaagctttcgaacgcgcaactcttgcaaagttttttgcagcaacattttttccgt

SEQ ID NO: 1403 - DNA, 82 bp, Bacillus sp.
ttttttccgtgtacatccccttcaatttccactaagctttcgaactcaaccatacttatttattttagcactgccccaaagt

SEQ ID NO: 1404 - DNA, 56 bp, Bacillus sp.
gccccaaagtgtacatccccttcaatttccactaagctttcgaacaacctctgctg

SEQ ID NO: 1405 - DNA, 35 bp, Bacillus sp.
gtacatccccttcaatttccactaagctttcgaac

SEQ ID NO: 1406 - DNA, 36 bp, Bacillus sp.; identical to SEQ ID NO: 1381

SEQ ID NO: 1407 - DNA, 83 bp, Desulfatirhabdium butyrativorans
cccatccatttgtccgtcgatcaagctgctttcaccatcggaaccccggccaccgaggcagccaacaccacccaggccgagct

SEQ ID NO: 1408 - DNA, 83 bp, Desulfatirhabdium butyrativorans
aggccgagctgtgtcagtcgatcaagctgttttcaccatcggaaccccttgaattgagacggttccggagcgcaatatggtga

SEQ ID NO: 1409 - DNA, 59 bp, Desulfatirhabdium butyrativorans
aatatggtgagtgtcagtcgatcaagctgttttcaccatcggaaccccccccggccatc

SEQ ID NO: 1410 - DNA, 38 bp, Desulfatirhabdium butyrativorans
gtgtcagtcgatcaagctgttttcaccatcggaacccc

SEQ ID NO: 1411 - DNA, 38 bp, Desulfatirhabdium butyrativorans; identical to SEQ ID NO: 1410

SEQ ID NO: 1412 - DNA, 19 bp, Desulfatirhabdium butyrativorans
gtgtcagtcgatcaagctg

SEQ ID NO: 1413 - DNA, 19 bp, Desulfatirhabdium butyrativorans
ttttcaccatcggaacccc

SEQ ID NO: 1414 - DNA, 82 bp, Brevibacillus agri
cgaggattttgtgctaaccacgaagctttccactaagctttcgaaccataccgccgtttactttacctggtacggcgactat

SEQ ID NO: 1415 - DNA, 81 bp, Brevibacillus agri
cggcgactatgtgctaaccacgaagctttccactaagctttcgaactctgcaagtgcgcgtctatgaaaagaactgggaaa

SEQ ID NO: 1416 - DNA, 86 bp, Brevibacillus agri
aactgggaaagtgctaaccacgaagctttccactaagctttcgaacgttcaaccttcttcgtgagaaaattgatgatattttgaag

SEQ ID NO: 1417 - DNA, 85 bp, Brevibacillus agri
tattttgaaggtgctaaccacgaagctttccactaagctttcgaaccggatcactctcaacagctccattacaacgatacttatt

SEQ ID NO: 1418 - DNA, 83 bp, Brevibacillus agri
gatacttattgtgctaaccacgaagctttccactaagctttcgaacgaagttatgaagaaagtctagcatgtattcccgatgt

SEQ ID NO: 1419 - DNA, 84 bp, Brevibacillus agri
ttcccgatgtgtgctaaccacgaagctttccactaagctttcgaaccatcaacagcaacatcaacacgagatcgaggttgaggc

SEQ ID NO: 1420 - DNA, 81 bp, Brevibacillus agri
aggttgaggcgtgctaaccacgaagctttccactaagctttcgaacctctgtttgcagcagcatacttcaaaaagtcttca

SEQ ID NO: 1421 - DNA, 85 bp, Brevibacillus agri
aaagtcttcagtgctaaccacgaagctttccactaagctttcgaacataatccgtttgctgtacggatataaaaatcttgtatag

SEQ ID NO: 1422 - DNA, 80 bp, Brevibacillus agri
tcttgtataggtgctaaccacgaagctttccactaagctttcgaaccgtatgcgaagtctgttatacaccgcattttatg

SEQ ID NO: 1423 - DNA, 57 bp, Brevibacillus agri
gcattttatggtgctaaccacgaagctttccactaagctttcgaactccttcccact

SEQ ID NO: 1424 - DNA, 36 bp, Brevibacillus agri; identical to SEQ ID NO: 1381

SEQ ID NO: 1425 - DNA, 87 bp, Brevibacillus agri
tggacaagctgtgctaaccacgaagctttccactaagctttcgaacttcttaacacgcgacgactctttccccacacgatttcgatg

SEQ ID NO: 1426 - DNA, 84 bp, Brevibacillus agri
gatttcgatggtgctaatcccgaagctttccactaagctttcgaacaactataacataacccaagcaaccgcttatagtttctg

SEQ ID NO: 1427 - DNA, 86 bp, Brevibacillus agri
atagtttctggtgctaatcccgaagctttccactaagctttcgaacaccagcgccttgtctgccatgtattgctgtgccaaagcca

SEQ ID NO: 1428 - DNA, 81 bp, Brevibacillus agri
gccaaagccagtgctaatcccgaagctttccactaagctttcgaactaaccgtaagcctgtaacgaagcgttcgctccaac

SEQ ID NO: 1429 - DNA, 81 bp, Brevibacillus agri
tcgctccaacgtgctaatcccgaagctttccactaagctttcgaactgggacggtgcacagcagaccgtaaaagatgcgtt

SEQ ID NO: 1430 - DNA, 82 bp, Brevibacillus agri
aagatgcgttgtgctaatcccgaagctttccactaagctttcgaacatctagtcaccccaaggataattgtcgtcgtagtcc

SEQ ID NO: 1431 - DNA, 84 bp, Brevibacillus agri
gtcgtagtccgtgctaatcccgaagctttccactaagctttcgaacctctagcttgctgtcgaagttagccctactgttgatga

SEQ ID NO: 1432 - DNA, 84 bp, Brevibacillus agri
ctgttgatgagtgctaatcccgaagctttccactaagctttcgaacatctgcatcacgggtagcaacgcccgcagtcaggtctt

SEQ ID NO: 1433 - DNA, 82 bp, Brevibacillus agri
gtcaggtcttgtgctaatcccgaagctttccactaagctttcgaacgaggatcgtgtctgtcaacgggtattgcacgcttcc

SEQ ID NO: 1434 - DNA, 84 bp, Brevibacillus agri
gcacgcttccgtgctaatcccgaagctttccactaagctttcgaacacggagtggattttagagaggggtggtttttgtttcta

SEQ ID NO: 1435 - DNA, 81 bp, Brevibacillus agri
tttgtttctagtgctaatcccgaagctttccactaagctttcgaacattttcgttgcccagacgggagagaggaagagagt

SEQ ID NO: 1436 - DNA, 82 bp, Brevibacillus agri
ggaagagagtgtgctaatcccgaagctttccactaagctttcgaactctcctgatacgccccatcagactgcttttctagca

SEQ ID NO: 1437 - DNA, 83 bp, Brevibacillus agri
ttttctagcagtgctaatcccgaagctttccactaagctttcgaactcatatttatcctgtaagcttccctcactcattttta

SEQ ID NO: 1438 - DNA, 82 bp, Brevibacillus agri
ctcatttttagtgctaatcccgaagctttccactaagctttcgaacttgattgttcggctaaggcgaaggacagagctaagg

SEQ ID NO: 1439 - DNA, 82 bp, Brevibacillus agri
agagctaagggtgctaatcccgaagctttccactaagctttcgaacgtcctgacataccgatgttcggcgctcggtcgaagt

SEQ ID NO: 1440 - DNA, 86 bp, Brevibacillus agri
cggtcgaagtgtgctaatcccgaagctttccactaagctttcgaacgccattcgccgagcctgcggacgtcttcttttccggatac

SEQ ID NO: 1441 - DNA, 81 bp, Brevibacillus agri
ttccggatacgtgctaatcccgaagctttccactaagctttcgaaccccaggaaacttatatcggcaatagtagctgtctg

SEQ ID NO: 1442 - DNA, 82 bp, Brevibacillus agri
tagctgtctggtgctaatcccgaagctttccactaagctttcgaacgtgctgcgagtacgagatcaagcaccgcaaggctaa

SEQ ID NO: 1443 - DNA, 85 bp, Brevibacillus agri
gcaaggctaagtgctaatcccgaagctttccactaagctttcgaacttgccacatttctctacacggggctgcgggtcagcgagc

SEQ ID NO: 1444 - DNA, 86 bp, Brevibacillus agri
gtcagcgagcgtgctaatcccgaagctttccactaagctttcgaacgtaacttgcttactcaaagtaagcgtgtagtcacccgccg

SEQ ID NO: 1445 - DNA, 85 bp, Brevibacillus agri
tcacccgccggtgctaatcccgaagctttccactaagctttcgaacggcacgaattcgacttcgtccgtatgggcgactatatga

SEQ ID NO: 1446 - DNA, 84 bp, Brevibacillus agri
gactatatgagtgctaatcccgaagctttccactaagctttcgaacactatggcaggattggcagaactttcgccgttttttca

SEQ ID NO: 1447 - DNA, 83 bp, Brevibacillus agri
cgttttttcagtgctaatcccgaagctttccactaagctttcgaaccccctttttgaccatgccaagaggaaaagatagcgga

SEQ ID NO: 1448 - DNA, 85 bp, Brevibacillus agri
agatagcggagtgctaatcccgaagctttccactaagctttcgaacttattttgggtctcgtgagtcgatgcagttgcgtatcta

SEQ ID NO: 1449 - DNA, 82 bp, Brevibacillus agri
tgcgtatctagtgctaatcccgaagctttccactaagctttcgaacccacgtggcgaaagcaagttttccatatcgtcataa

SEQ ID NO: 1450 - DNA, 81 bp, Brevibacillus agri
atcgtcataagtgctaatcccgaagctttccactaagctttcgaaccttctattttgggagttggtgctgtgatggtggcg

SEQ ID NO: 1451 - DNA, 82 bp, Brevibacillus agri
gatggtggcggtgctaatcccgaagctttccactaagctttcgaacttctttggtattcactccccatcccgtctcatggct

SEQ ID NO: 1452 - DNA, 83 bp, Brevibacillus agri
tctcatggctgtgctaatcccgaagctttccactaagctttcgaacgctagccgtggacaaggaagaaataaaggaactcatt

SEQ ID NO: 1453 - DNA, 82 bp, Brevibacillus agri
ggaactcattgtgctaatcccgaagctttccactaagctttcgaactaccactacctcaacgctcccgtcgaaaccatcatg

SEQ ID NO: 1454 - DNA, 80 bp, Brevibacillus agri
aaccatcatggtgctaatcccgaagctttccactaagctttcgaactatacaggcccgcttttttgatgtcgatgctgga

SEQ ID NO: 1455 - DNA, 82 bp, Brevibacillus agri
cgatgctggagtgctaatcccgaagctttccactaagctttcgaacggtttcttgatgaaacgcagcgcgtccgtaaaggat

SEQ ID NO: 1456 - DNA, 56 bp, Brevibacillus agri
cgtaaaggatgtgctaatcccgaagctttccactaagctttcgaacccctgtcttc

SEQ ID NO: 1457 - DNA, 36 bp, Brevibacillus agri; identical to SEQ ID NO: 1391

SEQ ID NO: 1458 - DNA, 36 bp, Brevibacillus agri; identical to SEQ ID NO: 1381

SEQ ID NO: 1459 - DNA, 397 bp, Brevibacillus sp.
gtgctaaccacgaagctttccactaagctttcgaacgcttacagcttccggtcaaccccgcatccatccgcatagtgctaatcccgaagctttccactaagctttcgaactcaagatcgaggcactgtacccgggcacgaaagggtgctaatcccgaagctttccactaagctttcgaacttaatatcttggttgtagttgcgcaaaccttttatgtgctaatcccgaagctttccactaagctttcgaaccttactcagtttgcgtcctccgaagaagtcgtccataagtgctaatcccgaagctttccactaagctttcgaacgcgacacgaccgtattcgtggacgagccggtctttgtgtgctaatcccgaagctttccactaagctttcgaa

SEQ ID NO: 1460 - DNA, 36 bp, Brevibacillus sp.; identical to SEQ ID NO: 1381

SEQ ID NO: 1461 - DNA, 80 bp, Methylobacterium nodulans
aacagatcgtgtgccaacgcgatcaggatctggcgcccactgcgaccccccgtgtccacatcgacggccgcgatgcacca

SEQ ID NO: 1462 - DNA, 81 bp, Methylobacterium nodulans
cgatgcaccagtgccaacgcgctcaggatctggcgcccactgcgacttccggcgaccctggatctgcacggctacacaact

SEQ ID NO: 1463 - DNA, 81 bp, Methylobacterium nodulans
ctacacaactgtgccaacgcgctcaggatctggcgcccactgcgacttggccccgccggcaccgggtaggagacccgccat

SEQ ID NO: 1464 - DNA, 79 bp, Methylobacterium nodulans
gacccgccatgtgccaacgcgctcaggatctggcgcccactgcgacatagttctggctgttggaggccagattgttctg

SEQ ID NO: 1465 - DNA, 81 bp, Methylobacterium nodulans
gattgttctggtgccaacgcgctcaggatctggcgcccactgcgacctgaccttcacgcgtgtctactcgggcgtggccaa

SEQ ID NO: 1466 - DNA, 81 bp, Methylobacterium nodulans
gcgtggccaagtgccaacgcgctcaggatctggcgcccactgcgacgtccaggccgagttgggcaaggtccgccggatcct

SEQ ID NO: 1467 - DNA, 56 bp, Methylobacterium nodulans
gccggatcctgtgccaacgcgctcaggatctggcgcccactgcgacggcgggcacg

SEQ ID NO: 1468 - DNA, 36 bp, Methylobacterium nodulans
gtgccaacgcgctcaggatctggcgcccactgcgac

SEQ ID NO: 1469 - DNA, 36 bp, Methylobacterium nodulans; identical to SEQ ID NO: 1468

SEQ ID NO: 1470 - DNA, 12 bp, Methylobacterium nodulans
gtgccaacgcgc

SEQ ID NO: 1471 - DNA, 24 bp, Methylobacterium nodulans
tcaggatctggcgcccactgcgac

SEQ ID NO: 1472 - DNA, 36 bp, Alicyclobacillus acidoterrestris; identical to SEQ ID NO: 1278

SEQ ID NO: 1473 - DNA, 37 bp, Desulfonatronum thiodismutans; identical to SEQ ID NO: 1284

SEQ ID NO: 1474 - DNA, 36 bp, Unknown; identical to SEQ ID NO: 1311
  Synthetic
  source (1)..(36): /note="Description of Unknown: Opitutaceae bacterium sequence"

SEQ ID NO: 1475 - DNA, 36 bp, Bacillus thermoamylovorans; identical to SEQ ID NO: 1365

SEQ ID NO: 1476 - DNA, 36 bp, Bacillus sp.; identical to SEQ ID NO: 1381

SEQ ID NO: 1477 - DNA, 38 bp, Desulfatirhabdium butyrativorans; identical to SEQ ID NO: 1410

SEQ ID NO: 1478 - DNA, 36 bp, Brevibacillus agri; identical to SEQ ID NO: 1381

SEQ ID NO: 1479 - DNA, 36 bp, Brevibacillus sp.; identical to SEQ ID NO: 1381

SEQ ID NO: 1480 - DNA, 36 bp, Methylobacterium nodulans; identical to SEQ ID NO: 1468

SEQ ID NO: 1481 - DNA, 36 bp, Alicyclobacillus acidoterrestris; identical to SEQ ID NO: 1278

SEQ ID NO: 1482 - DNA, 37 bp, Desulfonatronum thiodismutans; identical to SEQ ID NO: 1284

SEQ ID NO: 1483 - DNA, 36 bp, Unknown; identical to SEQ ID NO: 1311
  Synthetic
  source (1)..(36): /note="Description of Unknown: Opitutaceae bacterium sequence"

SEQ ID NO: 1484 - DNA, 36 bp, Bacillus thermoamylovorans; identical to SEQ ID NO: 1365

SEQ ID NO: 1485 - DNA, 36 bp, Bacillus sp.; identical to SEQ ID NO: 1381

SEQ ID NO: 1486 - DNA, 38 bp, Desulfatirhabdium butyrativorans; identical to SEQ ID NO: 1410

SEQ ID NO: 1487 - DNA, 36 bp, Brevibacillus agri; identical to SEQ ID NO: 1381

SEQ ID NO: 1488 - DNA, 36 bp, Brevibacillus sp.; identical to SEQ ID NO: 1381

SEQ ID NO: 1489 - DNA, 36 bp, Methylobacterium nodulans
gtcgcagtgggcgccagatcctgagcgcgttggcac

SEQ ID NO: 1490 - DNA, 36 bp, Artificial Sequence; identical to SEQ ID NO: 1278
  Synthetic

SEQ ID NO: 1491 - DNA, 37 bp, Artificial Sequence; identical to SEQ ID NO: 1284
  Synthetic

SEQ ID NO: 1492 - DNA, 36 bp, Artificial Sequence
  Synthetic
gccgcagcgaatgccgtttcacgaatcgtcaggcgg

SEQ ID NO: 1493 - DNA, 36 bp, Artificial Sequence; identical to SEQ ID NO: 1365
  Synthetic

SEQ ID NO: 1494 - DNA, 36 bp, Artificial Sequence
  Synthetic
gttcgaaagcttagtggaaagcttcgtggttagcac

SEQ ID NO: 1495 - DNA, 37 bp, Artificial Sequence
  Synthetic
gttcgaaagcttagtggaaattgaaggggatgtacca

SEQ ID NO: 1496 - DNA, 36 bp, Artificial Sequence
  Synthetic
ggggttccgatggtgaaaacagcttgatcgactgac

SEQ ID NO: 1497 - DNA, 36 bp, Artificial Sequence; identical to SEQ ID NO: 1494
  Synthetic

SEQ ID NO: 1498 - DNA, 36 bp, Artificial Sequence; identical to SEQ ID NO: 1494
  Synthetic

SEQ ID NO: 1499 - DNA, 36 bp, Artificial Sequence
  Synthetic
gtctcaacgggcgccagttcctgagctcgttggcac

SEQ ID NO: 1500 - DNA, 36 bp, Artificial Sequence
  Synthetic
tgatgtcagcgaaacgaccaccatcggggttataac

SEQ ID NO: 1501 - DNA, 36 bp, Artificial Sequence
  Synthetic
gggtgcggcatttgcgggtgttgggggagtggcagg

SEQ ID NO: 1502 - DNA, 36 bp, Artificial Sequence
  Synthetic
cagtggatgtttttccatgaggcgaagaatttcatc

SEQ ID NO: 1503 - DNA, 26 bp, Artificial Sequence
  Synthetic
aacaatataaacgactactttaccgt

SEQ ID NO: 1504 - DNA, 30 bp, Artificial Sequence
  Synthetic
agcttgtccaacttgatgctccttttcatc

SEQ ID NO: 1505 - DNA, 36 bp, Artificial Sequence
  Synthetic
atcatattcaagagcgtgtacactactacgccgaac

SEQ ID NO: 1506 - DNA, 38 bp, Artificial Sequence
  Synthetic
acagctcggcctgggtggtgttggctgcctcggtggcc

SEQ ID NO: 1507 - DNA, 30 bp, Artificial Sequence; identical to SEQ ID NO: 1504
  Synthetic

SEQ ID NO: 1508 - DNA, 30 bp, Artificial Sequence; identical to SEQ ID NO: 1504
  Synthetic

SEQ ID NO: 1509 - DNA, 34 bp, Artificial Sequence
  Synthetic
tgcatgcgctcctcgaggcggaggatccgatcgc

SEQ ID NO: 1510 - DNA, 200 bp, Artificial Sequence
  Synthetic
gtcggatcactgagtgatctaacctatcaaatgcccaaaccacctcctgcggggttcgaatcccttcgagtgcgccacaaacataagtaaaacgccggattcagtttatcgagtccagcgtttttcttttctactgcagtgttctacgcatcttactatgccgttgtaatacgaagatttgcgaacatcttggaatacag

SEQ ID NO: 1511 - DNA, 200 bp, Artificial Sequence
  Synthetic
gtctcggcaagcttggtcagtgatgggtgattgacatcagtgatgggtgattgacactagaagcgcacggcctaggttacgttcttggggaaagctaggcaagttttggatgataagaaataatcatgtcacaaggagggagtttttgtggcgagaatcaccatgtatcgaattcaaatcaatacagaagctataagaaa

SEQ ID NO: 1512 - DNA, 200 bp, Artificial Sequence
  Synthetic
gccgcagtgaatgccgtttcaccattgatgaagaatgcgaggtgaaaacagagaaattgggtcaactctatcactcttattcagccatcgtttcaagaaaggatacctcgtattggatacaacacagctcgttcgttctctctacctccctcgacaatctcaaggactatggcgatgccagcgatggaacagccgaggca

SEQ ID NO: 1513 - DNA, 200 bp, Artificial Sequence
  Synthetic
gttcaagaaaaaagaaatgatatgaggcattagcacgatgggatgggagagagaggacagttctactcttgctgtatccagcttcttttactttatccggtatcatttcttcacttctttctgcacataaaaaagcacctaactatttggataagttaagtgcttttatttccgtttgaagttgtctattgcttttttct

SEQ ID NO: 1514 - DNA, 200 bp, Artificial Sequence
  Synthetic
gttcgaaaacttggtgaaataccttgaaaattaacacatcaaagatgcccctgctttacgttaggggcatctttctattaaataacctatagtgaacttcaaaatcattgatctcttgataataatatataccaaattcaatagtcatagtgagaggtttacaggtgctcgatacgttttcttgcaaaaaagaagcagtc

SEQ ID NO: 1515 - DNA, 200 bp, Artificial Sequence
  Synthetic
gttcgaaagcttagtggaaattgaaggggatgtaccagaggtagcacttagcaagttttttgagaaacaagtatctggccccaatagctaggcttatgtgaaatgtagcatgagtggtgtgcaatgaaaaaatagggaggatattagcactatgaaaaagcagcttaaaaaaacagttaaatgcgtgatggcgtctatat

SEQ ID NO: 1516 - DNA, 200 bp, Artificial Sequence
  Synthetic
ggggttccgatggtgaaagcagcttgatcgacggacaaatggatgggcatgcgtaggggcggttcgcgaaccgcccctacaactacaccgaaagataccgcgactgaatctcggtgttggccagaagctcctgcctggtgccttcgtagcggatgaggcctttgtcgatgacatagccccgatcggagatggagagggcg

SEQ ID NO: 1517 - DNA, 200 bp, Artificial Sequence; identical to SEQ ID NO: 1514
  Synthetic

SEQ ID NO: 1518 - DNA, 200 bp, Artificial Sequence; identical to SEQ ID NO: 1514
  Synthetic

SEQ ID NO: 1519 - DNA, 200 bp, Artificial Sequence
  Synthetic
gtcgcaacggatcccagatcctgatctcgctggcaggtgccctggtagatgacgactcgcgctcgttgcagggaggctcgcgcagacgagcgggaaactgcttgtcaggcaatcgcctgtgctgggtccgctggattctgtgttcgttggcacgggggagccgtgggaatgcctactgcctggatggggtcgcaccaagt

SEQ ID NO: 1520 - DNA, 37 bp, Artificial Sequence
  Synthetic
gttcgaaagcttagtggaaattgaaggggatgtaccc

SEQ ID NO: 1521 - RNA, 36 nt, Artificial Sequence
  Synthetic
gucggaucacugagcgagcgaucugagaaguggcac

SEQ ID NO: 1522 - RNA, 158 nt, Artificial Sequence
  Synthetic
ucuagaggacagaauuuuucaacgggugugccaauggccacuuuccagguggcaaagcccguugagcuucucaaaaagaacgcucgcucaguguucugaccuuucgagcgccuguucagggcgaaaacccugggaggcgcucgaaucauaggugggac

SEQ ID NO: 1523 - RNA, 36 nt, Artificial Sequence; identical to SEQ ID NO: 27
  Synthetic

SEQ ID NO: 1524 - RNA, 75 nt, Artificial Sequence; identical to SEQ ID NO: 28
  Synthetic

SEQ ID NO: 1525 - RNA, 36 nt, Artificial Sequence; identical to SEQ ID NO: 30
  Synthetic

SEQ ID NO: 1526 - RNA, 107 nt, Artificial Sequence; identical to SEQ ID NO: 31
  Synthetic

SEQ ID NO: 1527 - RNA, 36 nt, Artificial Sequence; identical to SEQ ID NO: 1212
  Synthetic

SEQ ID NO: 1528 - RNA, 69 nt, Artificial Sequence; identical to SEQ ID NO: 34
  Synthetic

SEQ ID NO: 1529 - DNA, 79 bp, Unknown
  Synthetic
  source (1)..(79): /note="Description of Unknown: Lachnospiraceae bacterium sequence"
gaagaaatgactattgccaactatatctggcttttctcaatacccttagcgcgaaaataccccctcgccataaccaacc

SEQ ID NO: 1530 - DNA, 84 bp, Unknown
  Synthetic
  source (1)..(84): /note="Description of Unknown: Lachnospiraceae bacterium sequence"
ataaccaaccgtctattgccatctttatctggcttttctcaatactatcaaggtacagcaaatatgctcatcagtgctatgaag

SEQ ID NO: 1531 - DNA, 82 bp, Unknown
  Synthetic
  source (1)..(82): /note="Description of Unknown: Lachnospiraceae bacterium sequence"
tgctatgaaggtctattgccatctttatctggcttttctcaatacagtagaaatgattatacctgacaacgttaaagagagt

SEQ ID NO: 1532 - DNA, 79 bp, Unknown
  Synthetic
  source (1)..(79): /note="Description of Unknown: Lachnospiraceae bacterium sequence"
taaagagagtgtctattgccatctttatctggcttttctcaatacaaaagaaaccaaaaaattcattgcgtaacaccat

SEQ ID NO: 1533 - DNA, 80 bp, Unknown
  Synthetic
  source (1)..(80): /note="Description of Unknown: Lachnospiraceae bacterium sequence"
gtaacaccatgtctattgccaactatatctggcttttctcaatacaaaatacgcacagcctcattaccactcagtttatt

SEQ ID NO: 1534 - DNA, 80 bp, Unknown
  Synthetic
  source (1)..(80): /note="Description of Unknown: Lachnospiraceae bacterium sequence"
tcagtttattgtctattgccaactatatctggcttttctcaatactaaaatggatgattggtggctcgatgacactgtcc

SEQ ID NO: 1535 - DNA, 82 bp, Unknown
  Synthetic
  source (1)..(82): /note="Description of Unknown: Lachnospiraceae bacterium sequence"
gacactgtccgtctattgccaactatatctggcttttctcaatacagcttctagtggtatgccttcgggaccatcaaaggaa

SEQ ID NO: 1536 - DNA, 81 bp, Unknown
  Synthetic
  source (1)..(81): /note="Description of Unknown: Lachnospiraceae bacterium sequence"
atcaaaggaagtctattgccaactatatctggcttttctcaatacgcatatcttgaggattgggattctgaactcttagag

SEQ ID NO: 1537 - DNA, 82 bp, Unknown
  Synthetic
  source (1)..(82): /note="Description of Unknown: Lachnospiraceae bacterium sequence"
actcttagaggtctattgccaactatatctggcttttctcaatacctcacttattcacctgggttaactgcatgaactcaac

SEQ ID NO: 1538 - DNA, 55 bp, Unknown
  Synthetic
  source (1)..(55): /note="Description of Unknown: Lachnospiraceae bacterium sequence"
tgaactcaacgtctattgccaactttatctggcttttctcaataccctaccttct

SEQ ID NO: 1539 - DNA, 35 bp, Unknown
  Synthetic
  source (1)..(35): /note="Description of Unknown: Lachnospiraceae bacterium sequence"
gtctattgccaactatatctggcttttctcaatac

SEQ ID NO: 1540 - DNA, 35 bp, Unknown; identical to SEQ ID NO: 1539
  Synthetic
  source (1)..(35): /note="Description of Unknown: Lachnospiraceae bacterium sequence"

SEQ ID NO: 1541 - DNA, 78 bp, Unknown
  Synthetic
  source (1)..(78): /note="Description of Unknown: Lachnospiraceae bacterium sequence"
accttccagagttattgccctctatcttggactcttctcatcaactcataataccaagaagaaatcaagcatattatc

SEQ ID NO: 1542 - DNA, 80 bp, Unknown
  Synthetic
  source (1)..(80): /note="Description of Unknown: Lachnospiraceae bacterium sequence"
gcatattatcgttattgccctctatcttgggctcttctcatcaacacgagataggcaaaccgaagaacatgatatatata

SEQ ID NO: 1543 - DNA, 78 bp, Unknown
  Synthetic
  source (1)..(78): /note="Description of Unknown: Lachnospiraceae bacterium sequence"
gatatatatagttattgccctctatcttgggctcttctcatcaacgaatacgatacaactggcgactggtttgattaa

SEQ ID NO: 1544 - DNA, 55 bp, Unknown
  Synthetic
  source (1)..(55): /note="Description of Unknown: Lachnospiraceae bacterium sequence"
gtttgattaagttattgccctctatcttgggctcttctcatcaacaccgtcctct

SEQ ID NO: 1545 - DNA, 35 bp, Unknown
  Synthetic
  source (1)..(35): /note="Description of Unknown: Lachnospiraceae bacterium sequence"
gttattgccctctatcttgggctcttctcatcaac

SEQ ID NO: 1546 - DNA, 35 bp, Unknown; identical to SEQ ID NO: 1545
  Synthetic
  source (1)..(35): /note="Description of Unknown: Lachnospiraceae bacterium sequence"

SEQ ID NO: 1547 - DNA, 80 bp, Clostridium aminophilum
aaagagcagggtttggagaacagcccgatatagagggcaatagacgccttttgtcgcaagtgttgccgtaccggataacg

SEQ ID NO: 1548 - DNA, 80 bp, Clostridium aminophilum
ccggataacggtttggagaacagcccgatatagagggcaatagacgcaacatatgcttcatcggggaagagttctttccc

SEQ ID NO: 1549 - DNA, 80 bp, Clostridium aminophilum
gttctttcccgtttggagaacagcccgatatagagggcaatagacccggaagcaattcccccaatggcctgtccaagcca

SEQ ID NO: 1550 - DNA, 79 bp, Clostridium aminophilum
gtccaagccagtttggagaacagcccgatatagagggcaatagacttaattgccggatacttgagatggaacttgtcac

SEQ ID NO: 1551 - DNA, 78 bp, Clostridium aminophilum
aacttgtcacgtttggagaacagcccgatatagagggcaatagacatatcatcatcaagagtctgccttgcatcacaa

SEQ ID NO: 1552 - DNA, 79 bp, Clostridium aminophilum
tgcatcacaagtttggagaacagcccgatatagagggcaatagacgtttatgtaaactcttaacgagtaaccatcttaa

SEQ ID NO: 1553 - DNA, 81 bp, Clostridium aminophilum
accatcttaagtttggagaacagcccgataaagagggcaatagaccagaccataccttttcagacgggatctttaccatct

SEQ ID NO: 1554 - DNA, 79 bp, Clostridium aminophilum
tttaccatctgtttggagaacagcccgataaagagggcaatagacctgatgctgcgaatctgccagaactcttgcgacc

SEQ ID NO: 1555 - DNA, 56 bp, Clostridium aminophilum
tcttgcgaccgtttggagaacagcccgatatagagggcaatagacggtgtacttgt

SEQ ID NO: 1556 - DNA, 35 bp, Clostridium aminophilum
gtttggagaacagcccgatatagagggcaatagac

SEQ ID NO: 1557 - DNA, 35 bp, Clostridium aminophilum; identical to SEQ ID NO: 1556

SEQ ID NO: 1558 - DNA, 81 bp, Unknown
  Synthetic
  source (1)..(81): /note="Description of Unknown: Lachnospiraceae bacterium sequence"
agaagacagggttttgagaatagcccgacatagagggcaatagacaacggttttaccattgtcaaactcgcctgctgtcgt

SEQ ID NO: 1559 - DNA, 84 bp, Unknown
  Synthetic
  source (1)..(84): /note="Description of Unknown: Lachnospiraceae bacterium sequence"
ctgctgtcgtgttttgagaatagcccgacatagagggcaatagacttttgcttcgtcacggatggacttcacaatggcaacaac

SEQ ID NO: 1560 - DNA, 79 bp, Unknown
  Synthetic
  source (1)..(79): /note="Description of Unknown: Lachnospiraceae bacterium sequence"
tggcaacaacgttttgagaatagcccgacatagagggcaatagaccttcataaatccaagatacggatgcatgattacg

SEQ ID NO: 1561 - DNA, 77 bp, Unknown
  Synthetic
  source (1)..(77): /note="Description of Unknown: Lachnospiraceae bacterium sequence"
catgattacggttttgagaatagcccgacatagagggcaatagacttttaaagggatgataaggaagccgtatactc

SEQ ID NO: 1562 - DNA, 82 bp, Unknown
  Synthetic
  source (1)..(82): /note="Description of Unknown: Lachnospiraceae bacterium sequence"
ccgtatactcgttttgagaatagcccgacatagagggcaatagacctaagctggtttttccatgttgacaccttgcctagtt

SEQ ID NO: 1563 - DNA, 81 bp, Unknown
  Synthetic
  source (1)..(81): /note="Description of Unknown: Lachnospiraceae bacterium sequence"
ttgcctagttgttttgagaatagcccgacatagagggcaatagacttcttctcttgtcattcttctacctctaaaatctca

SEQ ID NO: 1564 - DNA, 35 bp, Unknown
  Synthetic
  source (1)..(35): /note="Description of Unknown: Lachnospiraceae bacterium sequence"
gttttgagaatagcccgacatagagggcaatagac

SEQ ID NO: 1565 - DNA, 35 bp, Unknown; identical to SEQ ID NO: 1564
  Synthetic
  source (1)..(35): /note="Description of Unknown: Lachnospiraceae bacterium sequence"

SEQ ID NO: 1566 - DNA, 35 bp, Unknown; identical to SEQ ID NO: 1564
  Synthetic
  source (1)..(35): /note="Description of Unknown: Lachnospiraceae bacterium sequence"

SEQ ID NO: 1567 - DNA, 76 bp, Carnobacterium gallinarum
aaaatggaaagttatagtcctcttacatttagaggtagtctttaattaaaagattacaatgaaggttatccacttc

SEQ ID NO: 1568 - DNA, 76 bp, Carnobacterium gallinarum
tatccacttcgttatagtcctcttacatttagaggtagtctttaatttaactcatgggatatgaattatcatttag

SEQ ID NO: 1569 - DNA, 76 bp, Carnobacterium gallinarum
tatcatttaggttatagtcctcttacatttagaggtagtctttaatgtattaggaacaataaacgactctttttta

SEQ ID NO: 1570 - DNA, 76 bp, Carnobacterium gallinarum
ctcttttttagttatagtcctcttacatttagaggtagtctttaattcaaattaatcgttctctttatatctggga

SEQ ID NO: 1571 - DNA, 76 bp, Carnobacterium gallinarum
atatctgggagttatagtcctcttacatttagaggtagtctttaattgattatatcgaaaatcaaataaatgcgct

SEQ ID NO: 1572 - DNA, 37 bp, Carnobacterium gallinarum
gttatagtcctcttacatttagaggtagtctttaatt

SEQ ID NO: 1573 - DNA, 76 bp, Carnobacterium gallinarum
ccaataaacggttatagtcctcttacatttagaggtagtctttaattctcctttttcatgaatggccgttaaccct

SEQ ID NO: 1574 - DNA, 76 bp, Carnobacterium gallinarum
cgttaaccctgttatagtcctcttacatttagaggtagtctttaattgcgacaatcagtatgattacgatgctgac

SEQ ID NO: 1575 - DNA, 76 bp, Carnobacterium gallinarum
cgatgctgacgttatagtcctcttacatttagaggtagtctttaatttttacataaaaaaaggagggtataatcat

SEQ ID NO: 1576 - DNA, 76 bp, Carnobacterium gallinarum
gtataatcatgttatagtcctcttacatttagaggtagtctttaatttacgccaagaattattaatgttgatgcaa

SEQ ID NO: 1577 - DNA, 76 bp, Carnobacterium gallinarum
gttgatgcaagttatagtcctcttacatttagaggtagtctttaatctttatccatgaattaactcatgcgattgc

SEQ ID NO: 1578 - DNA, 76 bp, Carnobacterium gallinarum
atgcgattgcgttatagtcctcttacatttagaggtagtctttaatagaaatatattaatagcgacttatattaca

SEQ ID NO: 1579 - DNA, 76 bp, Carnobacterium gallinarum
ttatattacagttatagtcctcttacatttagaggtagtctttaatatattggagaaaaaagaaaaagattagtca

SEQ ID NO: 1580 - DNA, 76 bp, Carnobacterium gallinarum
agattagtcagttatagtcctcttacatttagaggtagtctttaattcctctattgtacttaacatcatctactga

SEQ ID NO: 1581 - DNA, 56 bp, Carnobacterium gallinarum
catctactgagttatagtcctcttacatttagaggtagtctttaatacccttctat

SEQ ID NO: 1582 - DNA, 36 bp, Carnobacterium gallinarum
gttatagtcctcttacatttagaggtagtctttaat

SEQ ID NO: 1583 - DNA, 37 bp, Carnobacterium gallinarum; identical to SEQ ID NO: 1572

SEQ ID NO: 1584 - DNA, 76 bp, Carnobacterium gallinarum
tctagttctgattaaagactacccctaaatgtaaggggactataactcctcaatgcttttattttgagcgttcgct

SEQ ID NO: 1585 - DNA, 76 bp, Carnobacterium gallinarum
agcgttcgctattaaagactacccctaaatgtaaggggactataactaccgactagagaactctttagtcacttga

SEQ ID NO: 1586 - DNA, 76 bp, Carnobacterium gallinarum
agtcacttgaattaaagactacccctaaatgtaaggggactataactgcttttgttaaattgattattgggtcttc

SEQ ID NO: 1587 - DNA, 37 bp, Carnobacterium gallinarum
attaaagactacccctaaatgtaaggggactataact

SEQ ID NO: 1588 - DNA, 76 bp, Carnobacterium gallinarum
gttgaggggtaatataaactacctctaaatgtaagaggactataactttattagttgttcatctgtttttttttaa

SEQ ID NO: 1589 - DNA, 76 bp, Carnobacterium gallinarum
ttttttttaaaatataaactacctctaaatgtaagaggactataacctacaaaaacgactaaaaaagcgtttaaag

SEQ ID NO: 1590 - DNA, 76 bp, Carnobacterium gallinarum
gcgtttaaagaatataaactacctctaaatgtaagaggactataactttggttgtacccctttttgaacatatagg

SEQ ID NO: 1591 - DNA, 76 bp, Carnobacterium gallinarum
aacatataggaatataaactacctctaaatgtaagaggactataactgcgtaatgatgaggtggcagaatcaatgc

SEQ ID NO: 1592 - DNA, 76 bp, Carnobacterium gallinarum
gaatcaatgcaatataaactacctctaaatgtaagaggactataaccataaaaccttgattttcataagatatatc

SEQ ID NO: 1593 - DNA, 76 bp, Carnobacterium gallinarum
aagatatatcaatataaactacctctaaatgtaagaggactataacccaatagtcaattctgttagccagtaggga

SEQ ID NO: 1594 - DNA, 57 bp, Carnobacterium gallinarum
ccagtagggaaatataaactacctctaaatgtaagaggactataactgctatataaa

SEQ ID NO: 1595 - DNA, 36 bp, Carnobacterium gallinarum
aatataaactacctctaaatgtaagaggactataac

SEQ ID NO: 1596 - DNA, 37 bp, Carnobacterium gallinarum; identical to SEQ ID NO: 1587

SEQ ID NO: 1597 - DNA, 75 bp, Paludibacter propionicigenes
gcatgtccttgttttagttcccttcaattttgggataatccacaagtattactgctgcaatgcagattggcgtat

SEQ ID NO: 1598 - DNA, 75 bp, Paludibacter propionicigenes
attggcgtatgttgtagttcccttcaattttgggataatccacaagtattactgctgcaatgcagattggcgtat

SEQ ID NO: 1599 - DNA, 76 bp, Paludibacter propionicigenes
attggcgtatgttgtagttcccttcaattttgggataatccacaaggaaaacgaaaattataacttcaataaattc

SEQ ID NO: 1600 - DNA, 76 bp, Paludibacter propionicigenes
caataaattcgttgtagttccctttaattttgggataatccacaagagtaaaaccgtacaatggagaagataacgt

SEQ ID NO: 1601 - DNA, 76 bp, Paludibacter propionicigenes
aagataacgtgatgtagttcccttcaattttgggatagtccacaagagcggtgcggatttgagcgatgcgaatttg

SEQ ID NO: 1602 - DNA, 76 bp, Paludibacter propionicigenes
tgcgaatttggttgtagttcccttcaatattgggataatccacaaggaattaggattatgagtttatatagtttga

SEQ ID NO: 1603 - DNA, 76 bp, Paludibacter propionicigenes
tatagtttgagttgtagttcccttcaatattgggataattcacaagtaaacattaaaacaataaacggaagttcga

SEQ ID NO: 1604 - DNA, 76 bp, Paludibacter propionicigenes
ggaagttcgagttgtagttcccttcaattttgggataatccataagaaagcaaaaatgaacacaaaacaatttgaa

SEQ ID NO: 1605 - DNA, 76 bp, Paludibacter propionicigenes
acaatttgaagttttagttcccttcgattttgggataatccacaagtacagcagtaagcggaaacactcaggcaat

SEQ ID NO: 1606 - DNA, 76 bp, Paludibacter propionicigenes
ctcaggcaatgttgtagttcccttcaattttgggataatccacaaggccgtaaaaaatccacacaacgataagatg

SEQ ID NO: 1607 - DNA, 76 bp, Paludibacter propionicigenes
cgataagatggttttagttcccttcaattttgggataatccataagctcttactggctggtgccgggcttgctgca

SEQ ID NO: 1608 - DNA, 76 bp, Paludibacter propionicigenes
gcttgctgcagttgtagttcccttcaattttgggattatccacaagagaaagagtgatgaacgacgagcaggatat

SEQ ID NO: 1609 - DNA, 76 bp, Paludibacter propionicigenes
agcaggatatgttgtagttcccttcaattttgggattatccacaagttacacctgatcaatggaaattgcttagtg

SEQ ID NO: 1610 - DNA, 76 bp, Paludibacter propionicigenes
ttgcttagtggttgtagttcccttcaattttgggataatccacaagtgtgattaatgatattaccgtagctaacgg

SEQ ID NO: 1611 - DNA, 76 bp, Paludibacter propionicigenes
tagctaacgggttgtagttcccttcattattgggatagtccacaagaaaacaacctgcatggataaattatatgac

SEQ ID NO: 1612 - DNA, 76 bp, Paludibacter propionicigenes
attatatgacgttctagctcccttcaattttgggataatccacaagtaaaaacatatttgctgaagactatggaag

SEQ ID NO: 1613 - DNA, 76 bp, Paludibacter propionicigenes
actatggaaggttgtagttcccttcaatattgggataatccacaagtgctattcggaatagatttttaccccacca

SEQ ID NO: 1614 - DNA, 76 bp, Paludibacter propionicigenes
taccccaccagttgtagttcccttcaattttgggataattcacaagtgggattatgaaataaccgattataaacta

SEQ ID NO: 1615 - DNA, 76 bp, Paludibacter propionicigenes
ttataaactagttgtagttcccttcaattttgggataattcacaagagaaatcaaaaattgattcttcagtagctt

SEQ ID NO: 1616 - DNA, 76 bp, Paludibacter propionicigenes
tcagtagcttgttgtagttcccttcaattttgggataattcacaagcgaatcctaatggttatattactgcttcat

SEQ ID NO: 1617 - DNA, 76 bp, Paludibacter propionicigenes
actgcttcatgttgtagttcccttcaattttgggataattcacaagtaaattgaaaatttctggacaagctccagt

SEQ ID NO: 1618 - DNA, 76 bp, Paludibacter propionicigenes
aagctccagtgttgtagttcccttcaatattgggataatccacaagaaacgaatcacagaacatgtgaacctggta

SEQ ID NO: 1619 - DNA, 76 bp, Paludibacter propionicigenes
gaacctggtagttgtagttcccttcaattttgggataatccacaagagatgataacgtaggcaacatccctgataa

SEQ ID NO: 1620 - DNA, 76 bp, Paludibacter propionicigenes
tccctgataagttttagttcccttcaattttgggataatccacaagcgttattcaggagagagtttcaaagagtat

SEQ ID NO: 1621 - DNA, 76 bp, Paludibacter propionicigenes
caaagagtatgttttagttcccttcaatattgggataatccacaagtaaaacattggctaataacagaactagggc

SEQ ID NO: 1622 - DNA, 56 bp, Paludibacter propionicigenes
gaactagggcgttttagttcccttcaatattgggataatccacaagatagtatctg

SEQ ID NO: 1623 - DNA, 36 bp, Paludibacter propionicigenes
gttgtagttcccttcaattttgggataatccacaag

SEQ ID NO: 1624 - DNA, 36 bp, Paludibacter propionicigenes; identical to SEQ ID NO: 1623

SEQ ID NO: 1625 - DNA, 36 bp, Paludibacter propionicigenes; identical to SEQ ID NO: 1623

SEQ ID NO: 1626 - DNA, 36 bp, Paludibacter propionicigenes; identical to SEQ ID NO: 1623

SEQ ID NO: 1627 - DNA, 76 bp, Listeria seeligeri
tgttattgcagtaagagactacctctatatgaaagaggactaaaaccatatttccaaactccactttgactacacc

SEQ ID NO: 1628 - DNA, 76 bp, Listeria seeligeri
tgactacaccgtaagagactacctctatatgaaagaggactaaaacggtcccactacttgaggtacgaacatatca

SEQ ID NO: 1629 - DNA, 76 bp, Listeria seeligeri
gaacatatcagtaagagactacctctatatgaaagaggactaaaacttagtcaacccctcgctgcattttcacatt

SEQ ID NO: 1630 - DNA, 76 bp, Listeria seeligeri
ttttcacattgtaagagactacctctatatgaaagaggactaaaacgatggataatagggatagatcattagtccg

SEQ ID NO: 1631 - DNA, 56 bp, Listeria seeligeri
cattagtccggtaagagactacctctatatgaaagaggactaaaacgtctaatgtg

SEQ ID NO: 1632 - DNA, 36 bp, Listeria seeligeri
gtaagagactacctctatatgaaagaggactaaaac

SEQ ID NO: 1633 - DNA, 36 bp, Listeria seeligeri; identical to SEQ ID NO: 1632

SEQ ID NO: 1634 - DNA, 76 bp, Listeria weihenstephanensis
tattttcatagatttagagtacctcaaaacagaagaggactaaaacgcactctccgacaataatctcgtccatttt

SEQ ID NO: 1635 - DNA, 76 bp, Listeria weihenstephanensis
cgtccattttgatttagagtacctcaaaacaaaagaggactaaaacaactctgtacttgtgaagtacgttaaatcc

SEQ ID NO: 1636 - DNA, 56 bp, Listeria weihenstephanensis
cgttaaatccgatttagagtacctcaaaacaaaagaggactaaaacctcttttgtg

SEQ ID NO: 1637 - DNA, 36 bp, Listeria weihenstephanensis
gatttagagtacctcaaaacaaaagaggactaaaac

SEQ ID NO: 1638 - DNA, 76 bp, Listeria weihenstephanensis
gtctacaagtgatttagagtagctcaaaaaagaagaggtctaaaacagagatactgatactattgagcccagtcat

SEQ ID NO: 1639 - DNA, 76 bp, Listeria weihenstephanensis
gcccagtcatgatttagagtacctcaaaatagaagaggtctaaaactgttccaaggcttgctaactcacctttttc

SEQ ID NO: 1640 - DNA, 76 bp, Listeria weihenstephanensis
cacctttttcgatttagagtacctcaaaatagaagaggtctaaaacatcttgtttatatccgtatcggcacccaaa

SEQ ID NO: 1641 - DNA, 76 bp, Listeria weihenstephanensis
ggcacccaaagatttagagtgcctcaaaatagaagaggtctaaaactcactctccatccactcaatcagatcattt

SEQ ID NO: 1642 - DNA, 76 bp, Listeria weihenstephanensis
cagatcatttgatttagagtacctcaaaatagaagaggtctaaaactatcaatttccttttgatttcttaaatcag

SEQ ID NO: 1643 - DNA, 76 bp, Listeria weihenstephanensis
cttaaatcaggatttagagtacctcaaaatagaagaggtctaaaacgttccaatatggttttttccacatcttccg

SEQ ID NO: 1644 - DNA, 57 bp, Listeria weihenstephanensis
acatcttccggatttagagtacctcaaaatagaagaggtctaaaacctcaaattgaa

SEQ ID NO: 1645 - DNA, 36 bp, Listeria weihenstephanensis
gatttagagtacctcaaaatagaagaggtctaaaac

SEQ ID NO: 1646 - DNA, 36 bp, Listeria weihenstephanensis; identical to SEQ ID NO: 1637

SEQ ID NO: 1647 - DNA, 36 bp, Listeria weihenstephanensis; identical to SEQ ID NO: 1637

SEQ ID NO: 1648 - DNA, 75 bp, Listeria newyorkensis
cgtaatgcttgatttagagtacctcaaaacaaaagaggactaaaactacttgtcgatatggtatagcttttttca

SEQ ID NO: 1649 - DNA, 76 bp, Listeria newyorkensis
gcttttttcagatttagagtacctcaaaacaaaagaggactaaaactaaagcttctaaatggtggcgcgttacgcc

SEQ ID NO: 1650 - DNA, 76 bp, Listeria newyorkensis
gcgttacgccgatttagaatacctcaaaacaaaagaggactaaaacctagcaagccggtcgccgcgctcaaagtaa

SEQ ID NO: 1651 - DNA, 57 bp, Listeria newyorkensis
ctcaaagtaagatttagagtacctcaaaacaaaagaggactaaaacctcttttgtgg

SEQ ID NO: 1652 - DNA, 36 bp, Listeria newyorkensis; identical to SEQ ID NO: 1637

SEQ ID NO: 1653 - DNA, 36 bp, Listeria newyorkensis; identical to SEQ ID NO: 1637

SEQ ID NO: 1654 - DNA, 36 bp, Listeria newyorkensis; identical to SEQ ID NO: 1637

SEQ ID NO: 1655 - DNA, 78 bp, Leptotrichia wadei
atgatgtatgtaagttttagtccccttcgtttttggggtagtctaaatcctggtaaaccaatccacatcgaagaaaag

SEQ ID NO: 1656 - DNA, 76 bp, Leptotrichia wadei
cgaagaaaagaaagttttagtccccttcgtttttggggtagtctaaatcatgtagaagaagttattgtatctattt

SEQ ID NO: 1657 - DNA, 59 bp, Leptotrichia wadei
gtatctattttacgttttagtccccttcgtttttggggtagtctaaatctttatatcaa

SEQ ID NO: 1658 - DNA, 39 bp, Leptotrichia wadei
taagttttagtccccttcgtttttggggtagtctaaatc

SEQ ID NO: 1659 - DNA, 39 bp, Leptotrichia wadei; identical to SEQ ID NO: 1658

SEQ ID NO: 1660 - DNA, 39 bp, Leptotrichia wadei; identical to SEQ ID NO: 1658

SEQ ID NO: 1661 - DNA, 78 bp, Leptotrichia shahii
attctttagagttttagtccccttcgatattggggtggtctatatcgaaaaagaagagtttattcagatagatttgtc

SEQ ID NO: 1662 - DNA, 77 bp, Leptotrichia shahii
tagatttgtcgttttagtccccttcgatattggggtggtctatatcaatatggattacttggtagaacagcaatcta

SEQ ID NO: 1663 - DNA, 57 bp, Leptotrichia shahii
cagcaatctagttttagtccccttcgatattggggtggtctatatcccatcctaatt

SEQ ID NO: 1664 - DNA, 36 bp, Leptotrichia shahii
gttttagtccccttcgatattggggtggtctatatc

SEQ ID NO: 1665 - DNA, 36 bp, Leptotrichia shahii; identical to SEQ ID NO: 1664

SEQ ID NO: 1666 - DNA, 80 bp, Rhodobacter capsulatus
gaacatcatgggttcagtccgccgtcgtcttggcggtgatgtgaggctctcccagcataccaaaccgctggcgaccatca

SEQ ID NO: 1667 - DNA, 78 bp, Rhodobacter capsulatus
gcgaccatcaggttcagtccgccgtcgtcttggcggtgatgtgatgcacaggagagaccgatgaaaatcacggccttc

SEQ ID NO: 1668 - DNA, 79 bp, Rhodobacter capsulatus
cacggccttcggttcagtccgccgtcgtcttggcggtgacgtgaggcacctaaacaagaggttctacgatgccgaaagg

SEQ ID NO: 1669 - DNA, 58 bp, Rhodobacter capsulatus
tgccgaaaggggttcagtccgccgtcgtcttggcggtgatgtgaggctcaggtcccgc

SEQ ID NO: 1670 - DNA, 37 bp, Rhodobacter capsulatus
ggttcagtccgccgtcgtcttggcggtgatgtgaggc

SEQ ID NO: 1671 - DNA, 37 bp, Rhodobacter capsulatus; identical to SEQ ID NO: 1670

SEQ ID NO: 1672 - DNA, 37 bp, Rhodobacter capsulatus; identical to SEQ ID NO: 1670

SEQ ID NO: 1673 - DNA, 37 bp, Rhodobacter capsulatus; identical to SEQ ID NO: 1670

SEQ ID NO: 1674 - DNA, 80 bp, Rhodobacter capsulatus; identical to SEQ ID NO: 1666

SEQ ID NO: 1675 - DNA, 78 bp, Rhodobacter capsulatus
gcgaccatcaggttcagtccgccgtcgtcttggcggtgatgtgatgcacaggagagaccgatgaaaatcaacggcttc

SEQ ID NO: 1676 - DNA, 79 bp, Rhodobacter capsulatus
caacggcttcggttcagtccgccgtcgtcttggcggtgacgtgaggcacctaaacaagaggttctacgatgccgaaagg

SEQ ID NO: 1677 - DNA, 58 bp, Rhodobacter capsulatus; identical to SEQ ID NO: 1669

SEQ ID NO: 1678 - DNA, 37 bp, Rhodobacter capsulatus; identical to SEQ ID NO: 1670

SEQ ID NO: 1679 - DNA, 37 bp, Rhodobacter capsulatus; identical to SEQ ID NO: 1670

SEQ ID NO: 1680 - DNA, 37 bp, Rhodobacter capsulatus; identical to SEQ ID NO: 1670

SEQ ID NO: 1681 - DNA, 37 bp, Rhodobacter capsulatus; identical to SEQ ID NO: 1670

SEQ ID NO: 1682 - DNA, 80 bp, Rhodobacter capsulatus; identical to SEQ ID NO: 1666

SEQ ID NO: 1683 - DNA, 78 bp, Rhodobacter capsulatus; identical to SEQ ID NO: 1675

SEQ ID NO: 1684 - DNA, 79 bp, Rhodobacter capsulatus; identical to SEQ ID NO: 1676

SEQ ID NO: 1685 - DNA, 58 bp, Rhodobacter capsulatus; identical to SEQ ID NO: 1669

SEQ ID NO: 1686 - DNA, 37 bp, Rhodobacter capsulatus; identical to SEQ ID NO: 1670

SEQ ID NO: 1687 - DNA, 37 bp, Rhodobacter capsulatus; identical to SEQ ID NO: 1670

SEQ ID NO: 1688 - DNA, 37 bp, Rhodobacter capsulatus; identical to SEQ ID NO: 1670

SEQ ID NO: 1689 - DNA, 37 bp, Rhodobacter capsulatus; identical to SEQ ID NO: 1670

SEQ ID NO: 1690 - DNA, 35 bp, Unknown; identical to SEQ ID NO: 1539
  Synthetic
  source (1)..(35): /note="Description of Unknown: Lachnospiraceae bacterium sequence"

SEQ ID NO: 1691 - DNA, 35 bp, Unknown; identical to SEQ ID NO: 1545
  Synthetic
  source (1)..(35): /note="Description of Unknown: Lachnospiraceae bacterium sequence"

SEQ ID NO: 1692 - DNA, 35 bp, Clostridium aminophilum; identical to SEQ ID NO: 1556

SEQ ID NO: 1693 - DNA, 35 bp, Unknown; identical to SEQ ID NO: 1564
  Synthetic
  source (1)..(35): /note="Description of Unknown: Lachnospiraceae bacterium sequence"

SEQ ID NO: 1694 - DNA, 37 bp, Carnobacterium gallinarum; identical to SEQ ID NO: 1572

SEQ ID NO: 1695 - DNA, 36 bp, Carnobacterium gallinarum; identical to SEQ ID NO: 1595

SEQ ID NO: 1696 - DNA, 36 bp, Paludibacter propionicigenes; identical to SEQ ID NO: 1623

SEQ ID NO: 1697 - DNA, 36 bp, Listeria seeligeri; identical to SEQ ID NO: 1632

SEQ ID NO: 1698 - DNA, 36 bp, Listeria weihenstephanensis; identical to SEQ ID NO: 1637

SEQ ID NO: 1699 - DNA, 36 bp, Listeria newyorkensis; identical to SEQ ID NO: 1637

SEQ ID NO: 1700 - DNA, 39 bp, Leptotrichia wadei; identical to SEQ ID NO: 1658

SEQ ID NO: 1701 - DNA, 36 bp, Leptotrichia shahii; identical to SEQ ID NO: 1664

SEQ ID NO: 1702 - DNA, 37 bp, Rhodobacter capsulatus; identical to SEQ ID NO: 1670

SEQ ID NO: 1703 - DNA, 37 bp, Rhodobacter capsulatus; identical to SEQ ID NO: 1670

SEQ ID NO: 1704 - DNA, 37 bp, Rhodobacter capsulatus; identical to SEQ ID NO: 1670

SEQ ID NO: 1705 - DNA, 35 bp, Unknown; identical to SEQ ID NO: 1539
  Synthetic
  source (1)..(35): /note="Description of Unknown: Lachnospiraceae bacterium sequence"

SEQ ID NO: 1706 - DNA, 35 bp, Unknown; identical to SEQ ID NO: 1545
  Synthetic
  source (1)..(35): /note="Description of Unknown: Lachnospiraceae bacterium sequence"

SEQ ID NO: 1707 - DNA, 35 bp, Clostridium aminophilum; identical to SEQ ID NO: 1556

SEQ ID NO: 1708 - DNA, 35 bp, Unknown; identical to SEQ ID NO: 1564
  Synthetic
  source (1)..(35): /note="Description of Unknown: Lachnospiraceae bacterium sequence"

SEQ ID NO: 1709 - DNA, 37 bp, Carnobacterium gallinarum; identical to SEQ ID NO: 1572

SEQ ID NO: 1710 - DNA, 36 bp, Carnobacterium gallinarum; identical to SEQ ID NO: 1595

SEQ ID NO: 1711 - DNA, 36 bp, Paludibacter propionicigenes; identical to SEQ ID NO: 1623

SEQ ID NO: 1712 - DNA, 36 bp, Listeria seeligeri; identical to SEQ ID NO: 1632

SEQ ID NO: 1713 - DNA, 36 bp, Listeria weihenstephanensis; identical to SEQ ID NO: 1637

SEQ ID NO: 1714 - DNA, 36 bp, Listeria newyorkensis; identical to SEQ ID NO: 1637

SEQ ID NO: 1715 - DNA, 39 bp, Leptotrichia wadei; identical to SEQ ID NO: 1658

SEQ ID NO: 1716 - DNA, 36 bp, Leptotrichia shahii; identical to SEQ ID NO: 1664

SEQ ID NO: 1717 - DNA, 37 bp, Rhodobacter capsulatus; identical to SEQ ID NO: 1670

SEQ ID NO: 1718 - DNA, 37 bp, Rhodobacter capsulatus; identical to SEQ ID NO: 1670

SEQ ID NO: 1719 - DNA, 37 bp, Rhodobacter capsulatus; identical to SEQ ID NO: 1670

SEQ ID NO: 1720 - DNA, 35 bp, Artificial Sequence
  Synthetic
gtattgagaaaagccagatatagttggcaatagtc

SEQ ID NO: 1721 - DNA, 36 bp, Artificial Sequence
  Synthetic
attaaagactacctctaaatgtaagaggactataac

SEQ ID NO: 1722 - DNA, 36 bp, Artificial Sequence; identical to SEQ ID NO: 1582
  Synthetic

SEQ ID NO: 1723 - DNA, 36 bp, Artificial Sequence; identical to SEQ ID NO: 1721
  Synthetic

SEQ ID NO: 1724 - DNA, 36 bp, Artificial Sequence
  Synthetic
gttttagtcctcttctgttttgaggtactctaaatc

SEQ ID NO: 1725 - DNA, 36 bp, Artificial Sequence
  Synthetic
gttttagccctcttttgttctgaggtactctaaatc

SEQ ID NO: 1726 - DNA, 35 bp, Artificial Sequence; identical to SEQ ID NO: 1564
  Synthetic

SEQ ID NO: 1727 - DNA, 35 bp, Artificial Sequence; identical to SEQ ID NO: 1556
  Synthetic

SEQ ID NO: 1728 - DNA, 34 bp, Artificial Sequence
  Synthetic
tcacatcaccgccaagacgacggcggactgaacc

SEQ ID NO: 1729 - DNA, 34 bp, Artificial Sequence; identical to SEQ ID NO: 1728
  Synthetic

SEQ ID NO: 1730 - DNA, 34 bp, Artificial Sequence; identical to SEQ ID NO: 1728
  Synthetic

SEQ ID NO: 1731 - DNA, 35 bp, Artificial Sequence
  Synthetic
gctggagaagatagcccaagaaagagggcaataac

SEQ ID NO: 1732 - DNA, 36 bp, Artificial Sequence
  Synthetic
gttttagtcctcttttgttttgaggtactctaaatc

SEQ ID NO: 1733 - DNA, 36 bp, Artificial Sequence
  Synthetic
gatatagaccaccccaatatcgaaggggactaaaac

SEQ ID NO: 1734 - DNA, 28 bp, Artificial Sequence
  Synthetic
tggattatcccaaaattgaagggaacta

SEQ ID NO: 1735 - DNA, 36 bp, Artificial Sequence
  Synthetic
gttttagtcctctttcatatagaggtagtctcttac

SEQ ID NO: 1736 - DNA, 36 bp, Artificial Sequence
  Synthetic
atttcttctcttgtcattcttctacctttcgcacaa

SEQ ID NO: 1737 - DNA, 30 bp, Artificial Sequence
  Synthetic
tttccattttcccactactttctaaaaaga

SEQ ID NO: 1738 - DNA, 30 bp, Artificial Sequence
  Synthetic
tgattatatcgaaaatcaaataaatgcgct

SEQ ID NO: 1739 - DNA, 30 bp, Artificial Sequence
  Synthetic
cgtttattggtcagagtaaactcaactccg

SEQ ID NO: 1740 - DNA, 30 bp, Artificial Sequence
  Synthetic
tatgaaaataatgtaacaccaatcgtttgg

SEQ ID NO: 1741 - DNA, 29 bp, Artificial Sequence
  Synthetic
atattttttgtaacggcttgcaatcattt

SEQ ID NO: 1742 - DNA, 36 bp, Artificial Sequence
  Synthetic
ttcttctcttgtcattcttctacctctaaaatctca

SEQ ID NO: 1743 - DNA, 35 bp, Artificial Sequence
  Synthetic
ggtgtacttgttccactcaatccacttatcatctt

SEQ ID NO: 1744 - DNA, 33 bp, Artificial Sequence
  Synthetic
catgatgttcctttcttgggtatggggtaagcc

SEQ ID NO: 1745 - DNA, 33 bp, Artificial Sequence; identical to SEQ ID NO: 1744
  Synthetic

SEQ ID NO: 1746 - DNA, 33 bp, Artificial Sequence; identical to SEQ ID NO: 1744
  Synthetic

SEQ ID NO: 1747 - DNA, 34 bp, Artificial Sequence
  Synthetic
gctaacatctccggtgttattaccactccattct

SEQ ID NO: 1748 - DNA, 30 bp, Artificial Sequence
  Synthetic
aagcattacggcgtatcacgccaccaatta

SEQ ID NO: 1749 - DNA, 32 bp, Artificial Sequence
  Synthetic
tctaaagaattatctattctgtcttttaaatt

SEQ ID NO: 1750 - DNA, 38 bp, Artificial Sequence
  Synthetic
aaacaaggacatgcacatacccacatgtttttctcttg

SEQ ID NO: 1751 - DNA, 30 bp, Artificial Sequence
  Synthetic
tgcaataacattttctgatacttttggcgg

SEQ ID NO: 1752 - DNA, 200 bp, Artificial Sequence
  Synthetic
gtattgagaaaagccagatatagcatgaacacttcggtgtttgtgcttttttagtatgacgggcatgccgtcagtctgtggtgaaagtccacaaggggcgtagttgccaacgaaccccaaagcaactcccaaggtttacaccgtgaggtgtaggcgagaagaagggatagcaaaatcgtagcctgacgaacagaaacctg

SEQ ID NO: 1753 - DNA, 200 bp, Artificial Sequence
  Synthetic
attaaagactacctctaaatgtaagaaaaataaaaaaataaaagagttacatatagttaagaaaaagaagtaggaatatttattcctacttctttttcgttgtatttaatttatttatatgaaaatatgataagatagatatatagtattagaatggagggtattgttaagatgcgtataacaaaagtgaaaataaaatt

SEQ ID NO: 1754 - DNA, 200 bp, Artificial Sequence
  Synthetic
gttatagtcctcttacatttagaggttggaatggcaacagtttttttgacaaattttataaggtgcagaacttctttccgtatgctattccgattgtccttgacaatgagcctcctcggatgtgacgatcttcggcaggagctaacagttaaagttagactgcctcgctagcgttagcacatccgagctcattatcaagg

SEQ ID NO: 1755 - DNA, 200 bp, Artificial Sequence
  Synthetic
attaaagactacctggataggctacaattaactagacagaaaaattaaggtgtgtagactagaagaaaacataccaggaggaatttttatgtctaagagaacacgaagaactttttcacaagaattcaagcaacaaatcgtcaatctttacttagctggaaagccacgtgtagaaatcattcgagaatatgaactaacgg

SEQ ID NO: 1756 - DNA, 200 bp, Artificial Sequence
  Synthetic
gttttagtcctcttctgttttgaggtaatatatccgcctattcgcttgcaacaacataactataccagattattaatgaatctgcagcttgacagattagcaaaacataattattttttcataaattaagagacagctcagcagccatctcttaaattcaaccaattatcttctgctaacaaaataccttccttcttgaa

SEQ ID NO: 1757 - DNA, 200 bp, Artificial Sequence
  Synthetic
gttttagtcctcttctgttttgaggtattttttaatagcaaaatgaaattgcattctcccatccaatttcattttgaaattaactgcaacattctatatcaaatttctaatagtctctttactataccacaatactcttctgaaacttgatttgtttctatataaccattatcgatttttttctcacctagatgtctcaa

SEQ ID NO: 1758 - DNA, 200 bp, Artificial Sequence
  Synthetic
gttttgagaatagcccgacatagttatagagatgtataaatataaccgataaacattgactaatttgttgaagtcagtgtttatcggttttttgtgtaaatataggagttgttagaatgatactttttgcctaattttggaactttatgaggatataagatagacttgataaaaaggtaaaagaaaggttaaagagcatg

SEQ ID NO: 1759 - DNA, 200 bp, Artificial Sequence
  Synthetic
gtttgtagaacagcctgatatagagggcgataggactttggctgcatgactcgatcattaagcctgaaactaagttttcttgtgttgaaatcttcctaatactgaggtcgtaagaccatcttgattattcacgaatctgtgactctgttctgagaacaatctcatactataaggacaatgttttttgaaatggaggattt

SEQ ID NO: 1760 - DNA, 200 bp, Artificial Sequence
  Synthetic
tcacatcaccgccaagatgacggcgggaacccaatgcaaacggaggtgcggcaacagcaaggttgcaccggctggacttcggcggcagtctggcgcaacggggcgcaggacacggaagatgtggcgggggcaagatggacctgtttttcaaggccacggaatatgagaccctgcaggcctcatggctcaaggtccagcaa

SEQ ID NO: 1761 - DNA, 200 bp, Artificial Sequence; identical to SEQ ID NO: 1760
  Synthetic

SEQ ID NO: 1762 - DNA, 200 bp, Artificial Sequence; identical to SEQ ID NO: 1760
  Synthetic

SEQ ID NO: 1763 - DNA, 200 bp, Artificial Sequence
  Synthetic
gttggagaagagagcccaagatagaggagattgacatttattacaagcggagattaaaacgataactgagaaaaaatgaataacgctgatgaaaacggccggattcttggccgtttttttgtctatttgctaagtgcacaaagattgtgaaataacatctgctactatgtatttatcgaggtacgtaaatctaggtggtg

SEQ ID NO: 1764 - DNA, 200 bp, Artificial Sequence
  Synthetic
gttttagtcctcttttattttgaggtaatatattcacttgcaacaacataactataccagattattaatggatctgcatcttgacagattaccaaaacataattattttttcataaattaagagacaactcagaatacagaattgcctctacatgtctaattttcccactgtcaattcctctgcgcataatatctccacc

SEQ ID NO: 1765 - DNA, 200 bp, Artificial Sequence
  Synthetic
gatatagaccaccccaatatcgaaaagtgatatttaataaaaataacttctgagtgagaataaaatttcaattcttgctcattttttattgttttttgaatatggttgcttggttgttctgaaacgaaaatttttggagatgttttaaatttttaggttgaaaaaaaataagaattatactataataaataattatgcga

SEQ ID NO: 1766 - DNA, 250 bp, Artificial Sequence
  Synthetic
tggattatcccaaaattgaagggtaacactacagctgacatcaaagcacaaacaaccccgaatgaaattcatcattcggggttgtttttataaaggttagcttagctaattgcagtcctacagcaaatcactacttcttcaaacgcaatatctccggattttctgcaataaatttattggcagcttcgtagccctgatgatagatagtgaagtaagagtcgtagctaaactcatgaaaggtttcgatggc

SEQ ID NO: 1767 - DNA, 250 bp, Artificial Sequence
  Synthetic
gttttagtcctctttcatttagaggtatatcgtattcctacttaataatagtaattaaaacaaccaatgtaaaggatataatcaatatatttaaagtttgcacgagaatgcaatcattttattcataaatatcatatcatttataagctctattttccattttctaaggctaataaataaaactgctgtacctatggatctaaggaagacttatgcacacagtacagcaacttttcagcatgatttgtgt

SEQ ID NO: 1768 - RNA, 78 nt, Artificial Sequence; identical to SEQ ID NO: 1222
  Synthetic

SEQ ID NO: 1769 - RNA, 35 nt, Artificial Sequence; identical to SEQ ID NO: 1221
  Synthetic

SEQ ID NO: 1770 - RNA, 81 nt, Artificial Sequence; identical to SEQ ID NO: 1228
  Synthetic

SEQ ID NO: 1771 - RNA, 35 nt, Artificial Sequence; identical to SEQ ID NO: 1227
  Synthetic

SEQ ID NO: 1772 - RNA, 99 nt, Artificial Sequence; identical to SEQ ID NO: 40
  Synthetic

SEQ ID NO: 1773 - RNA, 36 nt, Artificial Sequence; identical to SEQ ID NO: 39
  Synthetic

SEQ ID NO: 1774 - RNA, 106 nt, Artificial Sequence
  Synthetic
uuaguauaccacaucaauauuaaaucucaaaaaaauaaggagccgucaaacauagcucccuacuucuauuuacucauaauccccaucuauccuuacuuuucguaaa

SEQ ID NO: 1775 - RNA, 36 nt, Artificial Sequence; identical to SEQ ID NO: 46
  Synthetic

SEQ ID NO: 1776 - DNA, 26 bp, Unknown
  Synthetic
  source (1)..(26): /note="Description of Unknown: Gut metagenome sequence"
cccataattgataggatctatgaggt

SEQ ID NO: 1777 - DNA, 17 bp, Unknown
  Synthetic
  source (1)..(17): /note="Description of Unknown: Gut metagenome sequence"
ctcccgaaaagccttgt

SEQ ID NO: 1778 - DNA, 26 bp, Unknown
  Synthetic
  source (1)..(26): /note="Description of Unknown: Gut metagenome sequence"
cccatgattgataggatctatgaggt

SEQ ID NO: 1779 - DNA, 18 bp, Unknown
  Synthetic
  source (1)..(18): /note="Description of Unknown: Gut metagenome sequence"
tttcccccgacaggcgta

SEQ ID NO: 1780 - DNA, 26 bp, Unknown
  Synthetic
  source (1)..(26): /note="Description of Unknown: Gut metagenome sequence"
cccataattgataggatctatgaggt

SEQ ID NO: 1781 - DNA, 17 bp, Unknown
  Synthetic
  source (1)..(17): /note="Description of Unknown: Gut metagenome sequence"
tccatatgaatggcgcg

SEQ ID NO: 1782 - DNA, 26 bp, Unknown
  Synthetic
  source (1)..(26): /note="Description of Unknown: Gut metagenome sequence"
cccataattgataggatctatgaggt

SEQ ID NO: 1783 - DNA, 17 bp, Unknown
  Synthetic
  source (1)..(17): /note="Description of Unknown: Gut metagenome sequence"
tgccgccgtcctgcatg

SEQ ID NO: 1784 - DNA, 26 bp, Unknown
  Synthetic
  source (1)..(26): /note="Description of Unknown: Gut metagenome sequence"
cccataattgataggatctatgaggt

SEQ ID NO: 1785 - DNA, 17 bp, Unknown
  Synthetic
  source (1)..(17): /note="Description of Unknown: Gut metagenome sequence"
gcccggaccacatgcac

SEQ ID NO: 1786 - DNA, 26 bp, Unknown
  Synthetic
  source (1)..(26): /note="Description of Unknown: Gut metagenome sequence"
cccataattgataggatctatgaggt

SEQ ID NO: 1787 - DNA, 17 bp, Unknown
  Synthetic
  source (1)..(17): /note="Description of Unknown: Gut metagenome sequence"
aaatataaatacattaa

SEQ ID NO: 1788 - DNA, 26 bp, Unknown
  Synthetic
  source (1)..(26): /note="Description of Unknown: Gut metagenome sequence"
cccataattgataggatctatgaggt

SEQ ID NO: 1789 - DNA, 17 bp, Unknown
  Synthetic
  source (1)..(17): /note="Description of Unknown: Gut metagenome sequence"
atcggttatacaggcta

SEQ ID NO: 1790 - DNA, 26 bp, Unknown
  Synthetic
  source (1)..(26): /note="Description of Unknown: Gut metagenome sequence"
cccataattgataggatctatgagga

SEQ ID NO: 1791 - DNA, 17 bp, Unknown
  Synthetic
  source (1)..(17): /note="Description of Unknown: Gut metagenome sequence"
acggcgccggaaaacat

SEQ ID NO: 1792 - DNA, 26 bp, Unknown
  Synthetic
  source (1)..(26): /note="Description of Unknown: Gut metagenome sequence"
cccataattgataggatctatgaggc

SEQ ID NO: 1793 - DNA, 17 bp, Unknown
  Synthetic
  source (1)..(17): /note="Description of Unknown: Gut metagenome sequence"
agagccgcgcctattgg

SEQ ID NO: 1794 - DNA, 26 bp, Unknown
  Synthetic
  source (1)..(26): /note="Description of Unknown: Gut metagenome sequence"
cccataattgataggatctatgaggt

SEQ ID NO: 1795 - DNA, 17 bp, Unknown
  Synthetic
  source (1)..(17): /note="Description of Unknown: Gut metagenome sequence"
aaaacggtcccactaat

SEQ ID NO: 1796 - DNA, 26 bp, Unknown
  Synthetic
  source (1)..(26): /note="Description of Unknown: Gut metagenome sequence"
cccataattgataggatctatgaggt

SEQ ID NO: 1797 - DNA, 17 bp, Unknown
  Synthetic
  source (1)..(17): /note="Description of Unknown: Gut metagenome sequence"
aaaacggtcccactaat

SEQ ID NO: 1798 - DNA, 26 bp, Unknown
  Synthetic
  source (1)..(26): /note="Description of Unknown: Gut metagenome sequence"
cccataattgataggatctatgaggt

SEQ ID NO: 1799 - DNA, 17 bp, Unknown
  Synthetic
  source (1)..(17): /note="Description of Unknown: Gut metagenome sequence"
tgagctgctggcccgca

SEQ ID NO: 1800 - DNA, 26 bp, Unknown
  Synthetic
  source (1)..(26): /note="Description of Unknown: Gut metagenome sequence"
cccataattgataggatctatgagga

SEQ ID NO: 1801 - DNA, 17 bp, Unknown
  Synthetic
  source (1)..(17): /note="Description of Unknown: Gut metagenome sequence"
tggttccaatgcagtaa

SEQ ID NO: 1802 - DNA, 26 bp, Unknown
  Synthetic
  source (1)..(26): /note="Description of Unknown: Gut metagenome sequence"
cccataattgataggatctatgaggt

SEQ ID NO: 1803 - DNA, 17 bp, Unknown
  Synthetic
  source (1)..(17): /note="Description of Unknown: Gut metagenome sequence"
acctataacggcaccta

SEQ ID NO: 1804 - DNA, 26 bp, Unknown
  Synthetic
  source (1)..(26): /note="Description of Unknown: Gut metagenome sequence"
cccataattgataggatctatgaggc

SEQ ID NO: 1805 - DNA, 26 bp, Unknown
  Synthetic
  source (1)..(26): /note="Description of Unknown: Gut metagenome sequence"
cccataattgataggatctatgaggt

SEQ ID NO: 1806 - DNA, 26 bp, Unknown
  Synthetic
  source (1)..(26): /note="Description of Unknown: Gut metagenome sequence"
cccataattgataggatctatgaggt

SEQ ID NO: 1807 - DNA, 18 bp, Unknown
  Synthetic
  source (1)..(18): /note="Description of Unknown: Gut metagenome sequence"
ttgccgccgtcctgcatg

SEQ ID NO: 1808 - DNA, 27 bp, Unknown
  Synthetic
  source (1)..(27): /note="Description of Unknown: Marine metagenome sequence"
cacgtagttttgaagggaagttagagg

SEQ ID NO: 1809 - DNA, 17 bp, Unknown
  Synthetic
  source (1)..(17): /note="Description of Unknown: Marine metagenome sequence"
accgaatatgagaactg

SEQ ID NO: 1810 - DNA, 27 bp, Unknown
  Synthetic
  source (1)..(27): /note="Description of Unknown: Marine metagenome sequence"
atcgtagttttgaagggaagttagagg

SEQ ID NO: 1811 - DNA, 17 bp, Unknown
  Synthetic
  source (1)..(17): /note="Description of Unknown: Marine metagenome sequence"
tacaaataaacatcaag

SEQ ID NO: 1812 - DNA, 26 bp, Unknown
  Synthetic
  source (1)..(26): /note="Description of Unknown: Marine metagenome sequence"
tcgtagttttgaagggaagttagagg

SEQ ID NO: 1813 - DNA, 16 bp, Unknown
  Synthetic
  source (1)..(16): /note="Description of Unknown: Marine metagenome sequence"
ccgctccggccgtgat

SEQ ID NO: 1814 - DNA, 27 bp, Unknown
  Synthetic
  source (1)..(27): /note="Description of Unknown: Marine metagenome sequence"
atcgtagttttgaagggaagttagagg

SEQ ID NO: 1815 - DNA, 27 bp, Unknown
  Synthetic
  source (1)..(27): /note="Description of Unknown: Marine metagenome sequence"
atcgtagttttgaagggaagttagagg

SEQ ID NO: 1816 - DNA, 27 bp, Unknown
  Synthetic
  source (1)..(27): /note="Description of Unknown: Marine metagenome sequence"
atcgtagttttgaagggaagttagagg

SEQ ID NO: 1817 - DNA, 26 bp, Unknown
  Synthetic
  source (1)..(26): /note="Description of Unknown: Marine metagenome sequence"
gttagaattgagaggatgttgaagga

SEQ ID NO: 1818 - DNA, 17 bp, Unknown
  Synthetic
  source (1)..(17): /note="Description of Unknown: Marine metagenome sequence"
ttacacggcctatggtc

SEQ ID NO: 1819 - DNA, 26 bp, Unknown
  Synthetic
  source (1)..(26): /note="Description of Unknown: Marine metagenome sequence"
gttagaattgagaggatgttgaaggt

SEQ ID NO: 1820 - DNA, 17 bp, Unknown
  Synthetic
  source (1)..(17): /note="Description of Unknown: Marine metagenome sequence"
cttatgcacaacccttt

SEQ ID NO: 1821 - DNA, 26 bp, Unknown
  Synthetic
  source (1)..(26): /note="Description of Unknown: Marine metagenome sequence"
gttagaattgagaggatgttgaagga

SEQ ID NO: 1822 - DNA, 17 bp, Unknown
  Synthetic
  source (1)..(17): /note="Description of Unknown: Marine metagenome sequence"
aactgaacggcttgttt

SEQ ID NO: 1823 - DNA, 26 bp, Unknown
  Synthetic
  source (1)..(26): /note="Description of Unknown: Marine metagenome sequence"
gttagaattgagaggatgttgaagga

SEQ ID NO: 1824 - DNA, 17 bp, Unknown
  Synthetic
  source (1)..(17): /note="Description of Unknown: Marine metagenome sequence"
tcttactaatttgccga

SEQ ID NO: 1825 - DNA, 26 bp, Unknown
  Synthetic
  source (1)..(26): /note="Description of Unknown: Marine metagenome sequence"
gttagaattgagaggatgttgaagga

SEQ ID NO: 1826 - DNA, 26 bp, Unknown
  Synthetic
  source (1)..(26): /note="Description of Unknown: Marine metagenome sequence"
gttagaattgagaggatgttgaagga

SEQ ID NO: 1827 - DNA, 26 bp, Unknown
  Synthetic
  source (1)..(26): /note="Description of Unknown: Marine metagenome sequence"
gttagaattgagaggatgttgaagga

SEQ ID NO: 1828 - DNA, 17 bp, Unknown
  Synthetic
  source (1)..(17): /note="Description of Unknown: Marine metagenome sequence"
aactgaacggcttgttt

SEQ ID NO: 1829 - DNA, 26 bp, Unknown
  Synthetic
  source (1)..(26): /note="Description of Unknown: Gut metagenome sequence"
cccataattgataggatctatgaggt

SEQ ID NO: 1830 - DNA, 27 bp, Unknown
  Synthetic
  source (1)..(27): /note="Description of Unknown: Marine metagenome sequence"
atcgtagttttgaagggaagttagagg

SEQ ID NO: 1831 - DNA, 26 bp, Unknown
  Synthetic
  source (1)..(26): /note="Description of Unknown: Marine metagenome sequence"
gttagaattgagaggatgttgaagga

SEQ ID NO: 1832 - DNA, 26 bp, Unknown
  Synthetic
  source (1)..(26): /note="Description of Unknown: Gut metagenome sequence"
cccataattgataggatctatgaggt

SEQ ID NO: 1833 - DNA, 27 bp, Unknown
  Synthetic
  source (1)..(27): /note="Description of Unknown: Marine metagenome sequence"
atcgtagttttgaagggaagttagagg

SEQ ID NO: 1834 - DNA, 26 bp, Unknown
  Synthetic
  source (1)..(26): /note="Description of Unknown: Marine metagenome sequence"
gttagaattgagaggatgttgaagga

SEQ ID NO: 1835 - DNA, 27 bp, Artificial Sequence
  Synthetic
cctctaacttcccttcaaaactacgat

SEQ ID NO: 1836 - DNA, 17 bp, Artificial Sequence
  Synthetic
cagttctcatattcggt

SEQ ID NO: 1837 - DNA, 225 bp, Artificial Sequence
  Synthetic
cctctaacttcccttcaaaactacgtgacaaaggttaacatattgtaattccacttgattttgtcataccagggagaaaattggcatggaaatggatcaatttcagcaccccgattcggtttggacatggaaatctaaccaacggggccgcaaggcaagtctgtggattccctacctcgatcaaataagaaaaattaaggggactcgctgggaatttgtttataa

SEQ ID NO: 1838 - DNA, 37 bp, Artificial Sequence; identical to SEQ ID NO: 1284
  Synthetic

SEQ ID NO: 1839 - DNA, 36 bp, Artificial Sequence; identical to SEQ ID NO: 1311
  Synthetic

SEQ ID NO: 1840 - DNA, 35 bp, Artificial Sequence
  Synthetic
cttcaacgaagccacgccgcgaacggcgtggagtg

SEQ ID NO: 1841 - DNA, 36 bp, Artificial Sequence
  Synthetic
gcttcaacgaagccacgccgcgaacggcgtggagtg

SEQ ID NO: 1842 - DNA, 36 bp, Artificial Sequence; identical to SEQ ID NO: 1365
  Synthetic

SEQ ID NO: 1843 - DNA, 36 bp, Artificial Sequence; identical to SEQ ID NO: 1381
  Synthetic

SEQ ID NO: 1844 - DNA, 36 bp, Artificial Sequence; identical to SEQ ID NO: 1381
  Synthetic

SEQ ID NO: 1845 - DNA, 36 bp, Artificial Sequence; identical to SEQ ID NO: 1381
  Synthetic

SEQ ID NO: 1846 - DNA, 38 bp, Artificial Sequence; identical to SEQ ID NO: 1410
  Synthetic

SEQ ID NO: 1847 - DNA, 36 bp, Artificial Sequence; identical to SEQ ID NO: 1391
  Synthetic

SEQ ID NO: 1848 - DNA, 36 bp, Artificial Sequence; identical to SEQ ID NO: 1468
  Synthetic

SEQ ID NO: 1849 - DNA, 28 bp, Artificial Sequence
  Synthetic
gtttcaatccgcgcccccgtgagggggc

SEQ ID NO: 1850 - DNA, 29 bp, Artificial Sequence
  Synthetic
cggatcatccccgcatccgcgggggacac

SEQ ID NO: 1851 - DNA, 31 bp, Artificial Sequence
  Synthetic
gtttcaatccgcgcccccgtgagagggcgac

SEQ ID NO: 1852 - DNA, 35 bp, Artificial Sequence; identical to SEQ ID NO: 1539
  Synthetic

SEQ ID NO: 1853 - DNA, 35 bp, Artificial Sequence
  Synthetic
gtctattgccatctttatctggcttttctcaatac

SEQ ID NO: 1854 - DNA, 35 bp, Artificial Sequence; identical to SEQ ID NO: 1545
  Synthetic

SEQ ID NO: 1855 - DNA, 35 bp, Artificial Sequence
  Synthetic
gttattgccctctttcttgggctatcttctccagc

SEQ ID NO: 1856 - DNA, 35 bp, Artificial Sequence; identical to SEQ ID NO: 1556
  Synthetic

SEQ ID NO: 1857 - DNA, 35 bp, Artificial Sequence; identical to SEQ ID NO: 1564
  Synthetic

SEQ ID NO: 1858 - DNA, 36 bp, Artificial Sequence; identical to SEQ ID NO: 1582
  Synthetic

SEQ ID NO: 1859 - DNA, 36 bp, Artificial Sequence; identical to SEQ ID NO: 1582
  Synthetic

SEQ ID NO: 1860 - DNA, 30 bp, Artificial Sequence
  Synthetic
gttcttaatctaaaatagtgaaatgtaaat

SEQ ID NO: 1861 - DNA, 32 bp, Artificial Sequence
  Synthetic
gcatttacattacattattttagattaagaac

SEQ ID NO: 1862 - DNA, 36 bp, Artificial Sequence
  Synthetic
actacattatagctgattctgtaaggaaactatagc

SEQ ID NO: 1863 - DNA, 36 bp, Artificial Sequence; identical to SEQ ID NO: 1862
  Synthetic

SEQ ID NO: 1864 - DNA, 28 bp, Artificial Sequence
  Synthetic
tagttcccttcaattttgggattatcca

SEQ ID NO: 1865 - DNA, 26 bp, Artificial Sequence
  Synthetic
cctttcaaacgaagggcacttacaac

SEQ ID NO: 1866 - DNA, 29 bp, Artificial Sequence
  Synthetic
gttttaactacttattgtgaaatgtaaat

SEQ ID NO: 1867 - DNA, 29 bp, Artificial Sequence
  Synthetic
gttttaattacttattgtgaaatgtaaat

SEQ ID NO: 1868 - DNA, 36 bp, Artificial Sequence; identical to SEQ ID NO: 1632
  Synthetic

SEQ ID NO: 1869 - DNA, 36 bp, Artificial Sequence
  Synthetic
gatttagagtacctcaaaacagaagaggactaaaac

SEQ ID NO: 1870 - DNA, 36 bp, Artificial Sequence
  Synthetic
gatttagagtagctcaaaaaagaagaggtctaaaac

SEQ ID NO: 1871 - DNA, 36 bp, Artificial Sequence; identical to SEQ ID NO: 1637
  Synthetic

SEQ ID NO: 1872 - DNA, 29 bp, Artificial Sequence
  Synthetic
gttttagtccccttcgtttttggggtagt

SEQ ID NO: 1873 - DNA, 34 bp, Artificial Sequence
  Synthetic
tcaatccttattttaatggattcactattcttac

SEQ ID NO: 1874 - DNA, 29 bp, Artificial Sequence
  Synthetic
gttttaatagcacaaattgtattgtaaat

SEQ ID NO: 1875 - DNA, 37 bp, Artificial Sequence
  Synthetic
gtttcaatccttgttttaatggataacttactttaac

SEQ ID NO: 1876 - DNA, 37 bp, Artificial Sequence
  Synthetic
gtttcaatccttgttttaatggatactctactttaac

SEQ ID NO: 1877 - DNA, 36 bp, Artificial Sequence; identical to SEQ ID NO: 1664
  Synthetic

SEQ ID NO: 1878 - DNA, 29 bp, Artificial Sequence
  Synthetic
acctctcccgccagtaagcggattgagac

SEQ ID NO: 1879 - DNA, 37 bp, Artificial Sequence
  Synthetic
gcccagacacctctcccgccagtaagcggattgagac

SEQ ID NO: 1880 - DNA, 37 bp, Artificial Sequence; identical to SEQ ID NO: 1879
  Synthetic

SEQ ID NO: 1881 - DNA, 32 bp, Artificial Sequence
  Synthetic
gtcgctccccccgcgggggcgtggatcgaaac

SEQ ID NO: 1882 - DNA, 32 bp, Artificial Sequence; identical to SEQ ID NO: 1881
  Synthetic

SEQ ID NO: 1883 - DNA, 34 bp, Artificial Sequence
  Synthetic
ggttcagtccgccgtcgtcttggcggtgatgtga

SEQ ID NO: 1884 - DNA, 23 bp, Artificial Sequence
  Synthetic
gccctctcctcctccctgggccg

SEQ ID NO: 1885 - DNA, 34 bp, Artificial Sequence; identical to SEQ ID NO: 1883
  Synthetic

SEQ ID NO: 1886 - DNA, 34 bp, Artificial Sequence; identical to SEQ ID NO: 1883
  Synthetic

SEQ ID NO: 1887 - DNA, 3994 bp, Listeria weihenstephanensis
tggctgctgagctgtctcttaatttatgaaaaaataattatgttttgctaatctgtcaagctgcagattcattaataatctggtatagttatgttgttgcaagcgaataggcggatatattacctcaaaacagaagaggactaaaacccaaacgattggtgttacattattttcatagatttagagtacctcaaaacagaagaggactaaaacgcactctccgacaataatctcgtccattttgatttagagtacctcaaaacaaaagaggactaaaacaactctgtacttgtgaagtacgttaaatccgatttagagtacctcaaaacaaaagaggactaaaacctcttttgtggataagtattcgaaataaagccataaaaactgtgatccaaagaactggattattggtttttatggctttattcaattcttagtattgtagatgaactgtcagcgaatgttgtcttgcaacgtgccttcttgtataatgaatatattgataaataatagaaatttcatacacgcatgaagaaaccaattaaagtttcagcaataatgaagcattaggtacatgactataaaaccaaatggagctgagtagacagatgaaaatcacaaagatgagagtagatggaagaactatcgtaatggagaggacaagtaaggaaggtcaactggtttatgaaggtatcgatggaaataagacaacagaaattatatttgataagaaaaaagaatcgttttataagagtatcctcaataaaactgtgagaaaacctgatgaaaaaagaaaaaaaataggcgtaagcaggcaattaataaagcgattaataaagaaataacagaattaatgttggcgctgttacatcaagaagtgccaagccaaaagttacataatttaaagagtctaaatacggaatctttaactaaactatttaaaccgaagttccaaaacatgatttcttatccgcctagcaaaggtgccgaacatgttcaattttgccttacagatatagcggtaccagcgattcgagatttagatgaaattaagccagattggggcattttttttgaaaaattgaaaccctatacggattgggcagaatcatacattcactataagcagacaaccatacagaaatccattgagcaaaacaaaatacagtcccctgattcgccaaggaaattagtattgcaaaaatatgtcacagcctttttgaatggagaaccgctgggactcgatcttgtggcgaaaaaatataaactggcagacttagcggagtcgtttaaagtagtagatttgaacgaggataaaagtgcaaactataaaattaaagcgtgcttgcaacaacatcagcgaaatattttggatgaattgaaagaagatccagagttaaatcaatatggtatagaagtgaagaagtatatacagcgatatttcccaatcaaacgtgcaccgaatagaagtaaacatgcgcgagcggactttttgaaaaaggaattaattgagtctacagtggagcagcaatttaaaaatgctgtatatcattatgtactggaacaaggaaaaatggaggcatatgagctaacagatcctaaaacaaaagacttgcaggatattagatctggtgaggcatttagcttcaaatttattaatgcttgcgccttcgcatccaataatttgaagatgattttaaaccctgaatgtgaaaaggatattttaggtaagggcgattttaaaaagaatttgccaaacagtactacgcagtctgatgttgtgaaaaaaatgattccttttttctcggatgagattcaaaatgtgaattttgatgaagctatctgggcgattaggggctctattcagcaaattagaaatgaggtttaccattgcaaaaagcattcttggaaaagcatacttaaaataaaaggctttgaatttgaacctaacaatatgaaatatacggattctgatatgcaaaaattgatggataaagatatcgccaaaattccagacttcatcgaagaaaaacttaaaagtagtgggataataaggttctacagtcatgataaattgcagtctatctgggaaatgaagcaagggttttcgttgttgactactaatgcgccgtttgtcccaagctttaaacgtgtctacgcaaaagggcacgactaccaaacttctaaaaatagatattatgatttaggtttgactacttttgatattttggaatatggagaagaagattttcgtgcacgctatttcctgacgaagctagtttattatcaacaatttatgccatggtttacagctgataataatgctttccgagatgctgccaattttgtattgcgattaaataaaaatagacagcaggatgcaaaagcttttattaacattagagaagttgaagaaggtgagatgcctagagactatatgggctatgtccaaggtcaaatagcgatacatgaggattcaactgaggatacaccgaatcattttgaaaaatttattagccaggtttttattaagggatttgatagtcatatgagatctgctgatttaaaatttattaaaaatccaagaaatcaggggctagaacaaagtgaaattgaggaaatgagctttgatattaaagtagagccatcatttttgaaaaataaagatgactatattgcattttggacattctgcaaaatgctggatgctaggcatttaagcgagctaagaaacgaaatgattaagtatgacggtcatttaactggagaacaagaaatcattggtttagcattgcttggagtggattcacgagagaatgattggaagcaattttttagctcagaacgggaatacgagaaaattatgaagggctatgttggagaggaattgtatcagcgggaaccgtaccgacaaagtgatggcaaaacaccgattctttttcgtggtgtagagcaagcgaggaagtatggtactgaaacagtgattcaacggctttttgatgctagtcctgagtttaaagtgtcgaaatgcaacataactgagtgggagcggcaaaaagaaaccattgaagagactattgagcgaagaaaagaattgcataatgaatgggaaaaaaatcccaaaaaaccgcaaaataatgcattttttaaagagtataaagagtgttgtgacgctattgatgcttacaattggcataaaaataaaactacgcttgtatacgttaatgagctgcaccatttgctaattgaaattctgggaagatatgttggctatgtagcaatagctgatagagactttcaatgtatggcgaatcaatattttaagcattcaggaataactgagagagtggaatattggggcgataatagactaaaaagtattaaaaagctggatacattcttgaaaaaagaaggactgtttgtttctgagaaaaatgcaaggaatcatatagcgcatttaaattatttatcactcaaatctgagtgcacgttgctgtatttatctgagaggttgagagaaatttttaagtatgatcgtaaattaaagaatgccgtttccaagtcattaatcgatattttagatagacatggtatgagcgtcgtatttgctaacttgaaagaaaataaacataggttggtgataaaaagcttagagccaaaaaaattgagacatctaggtgagaaaaaaatcgataatggttatatagaaacaaatcaagtttcagaagagtattgtggtatagtaaagagactattagaaatttgatatagaatgttgcagttaatttcaaaatgaaattggatgggagaatgcaatttcattttgctattaaaaaatacctcaaaacagaagaggactaaaacaaatgattgcaagccgttacaaaaaatatgatttagagtacctcagaacaaaagagggctaaaactagaataatcgagtgagacggtctacaagtgatttagagtagctcaaaaaagaagaggtctaaaa

SEQ ID NO: 1888 - DNA, 4053 bp, Listeria newyorkensis
tgtattctgagttgtctcttaatttatgaaaaaataattatgttttggtaatctgtcaagatgcagatccattaataatctggtatagttatgttgttgcaagtgaatatattacctcaaaataaaagaggactaaaactaattggtggcgtgatacgccgtaatgcttgatttagagtacctcaaaacaaaagaggactaaaactacttgtcgatatggtatagcttttttcagatttagagtacctcaaaacaaaagaggactaaaactaaagcttctaaatggtggcgcgttacgccgatttagaatacctcaaaacaaaagaggactaaaacctagcaagccggtcgccgcgctcaaagtaagatttagagtacctcaaaacaaaagaggactaaaacctcttttgtggataagtattcgaaataaagccataaaaactgtgatccaaagagctggattattggtttttatggctttattcaattcttagtattgtagatgaaccatcagtgaatgttgtcttgcaacgtgccttcttgtataatgaatatattgataaataatagaaatttcatacacgcatgaagaaaccaattaaattttcagcattaatgaagcattaggtacatgactataaaaccaaatggagctgagtagacagatgaaaatcacaaagatgagagtagatggaagaactatcgtaatggagaggacaagcaaggaaggtcaactgggttatgaaggtatcgatggaaataagacaacagaaattatatttgataagaaaaaagagtcattttataagagtatcctcaataaaactgtgagaaaacccgatgaaaaagaaaagaataggcgtaagcaggcaattaataaagcgattaataaagaaataacagaattaatgttggcggtgttacatcaagaagtgccaagccaaaagttacataatttaaagagtctaaatacggaatctttaactaaactatttaaaccgaagttccaaaacatgatttcttatccgcctagcaaaggtgccgaacatgttcagttttgccttacagatatagcggtaccagcgattcgagatttagatgaaattaagccagattggggcattttttttgaaaaattgaaaccctatacggattgggcagaatcatacattcactataagcagacaaccatacagaaatccattgagcaaaacaaaatacagtcccctgattcgccaaggaaattagtattgcaaaaatatgtcacagcctttttgaatggagaaccgctgggactcgatcttgtggcgaaaaaatataaactggcagacttagcggagtcgtttaaattagtagatttgaacgaggataaaagtgcaaactataaaattaaagcgtgcttgcaacaacatcagcgaaatattttggatgaattgaaagaagatccggagttaaatcaatatggtatagaagtgaagaaatatatacagcgatatttcccaatcaaacgtgcaccgaatagaagtaaacatgcacgagcggactttttgaaaaaggaattaattgagtctacagtggagcaacaatttaaaaatgctgtatatcattatgtactggaacaaggcaaaatggaggcatatgagctaacagatcctaaaacaaaagacttgcaggatattagatctggtgaggcatttagcttcaaatttattaatgcttgcgccttcgcatcgaataatttgaagatgattttaaaccctgaatgtgaaaaggatatcctaggtaagggcaattttaaaaagaatttgccaaacagtactacgcgatctgatgttgtgaagaaaatgattccctttttctcggatgagcttcaaaatgtgaattttgatgaagctatctgggcgattaggggctctattcagcaaattagaaatgaggtttaccattgtaaaaagcattcttggaaaagcatacttaaaataaaaggctttgaatttgaacctaacaatatgaaatatgcggattctgatatgcaaaaattgatggataaagatatcgccaaaattccagagttcatcgaagaaaaacttaaaagtagtggagtagtaaggttctacaggcatgatgagttgcaatccatatgggaaatgaaacaaggattttcgttgctgactactaatgcgccgtttgtcccaagctttaagcgtgtctacgcaaaagggcacgactaccaaacttctaaaaatagatactataatttggatttgactacttttgatattttggaatatggagaagaagattttcgtgcacgctatttcctgacgaagctagtttattatcagcaatttatgccatggtttacagctgataataatgctttccgagatgctgccaattttgtattgcgattaaataaaaatagacagcaggatgcaaaagcttttattaacattagagaagttgaagaaggtgagatgcctagagactatatgggttatgtccaaggtcaaatagcgatacatgaggattcaattgaggatacaccgaatcattttgagaaatttattagtcaggtttttattaagggctttgataggcatatgagatctgctaatttaaaatttattaaaaatccaagaaatcaggggctagaacaaagtgagattgaggaaatgagctttgatattaaagtggagccgtcatttttgaaaaataaagatgactatattgcattttggatattctgcaaaatgcttgatgctaggcatttaagcgagctaagaaacgaaatgattaagtatgacggtcatttaactggagaacaagaaatcattggtttagcattgctcggagtggattcacgagagaatgattggaagcagttttttagctcagaacgggaatacgagaaaattatgaagggctatgttgtagaggaattgtatcagcgggaaccgtaccgacaaagtgatggcaaaacaccgattctttttcgtggtgtagagcaagcgaggaagtatggtactgaaacagtgattcaacggctttttgatgctaatcctgagttcaaagtgtcaaaatgcaacttagcagagtgggagcggcaaaaagaaaccattgaagagactattaagcgaagaaaagaattgcataatgaatgggcaaaaaatccaaaaaaaccgcaaaataatgcattttttaaagagtataaagagtgttgtgacgctattgacgcttacaattggcataaaaataaaactacgcttgcatacgttaatgagctgcaccatttgctaattgaaattctgggaagatatgttggctatgtagcaatagctgatagagactttcaatgtatggcgaatcaatattttaagcattcaggaataactgagagagtggaatattggggcgataatagactaaaaagtattaaaaagctggatacattcttgaaaaaagaaggactgtttgtttctgagaaaaatgcaaggaatcatatagcgcatttaaattatttatcactcaaatctgagtgcacgttgctgtatttatccgagaggttgagagaaatttttaagtatgatcgtaaattaaagaatgccgtttccaagtcattaatcgatattttagatagacatggtatgagcgtcgtatttgctaacttgaaagaaaataaacataggttggtgataaaaagcttagagccaaaaaaattgagacatctgggtgggaaaaaaatcgatggtggttatatagaaacaaatcaagtttcagaagagtattgtggtatagtgaagagactgttagaaatgtgatgtaggatgttacagtcaatctcaaaatgaaattggaagttacaagaggacgtaatatgatgttactattaaaaatacctcagaatagaagaggactaaaacaaatgattgcaagccgttacaaaaaatatgatttagagtacctcagaacaaaagagggctaaaactagaataatcgattgagacggtctacaagtgatttagagtacctcaaaacagaagaggactaaaa

SEQ ID NO: 1889 - DNA, 36 bp, Artificial Sequence; identical to SEQ ID NO: 1721
  Synthetic

SEQ ID NO: 1890 - DNA, 36 bp, Artificial Sequence; identical to SEQ ID NO: 1721
  Synthetic

SEQ ID NO: 1891 - DNA, 36 bp, Artificial Sequence
  Synthetic
attaaagactacccctaaatgtaaggggactataac

SEQ ID NO: 1892 - DNA, 36 bp, Artificial Sequence; identical to SEQ ID NO: 1595
  Synthetic

SEQ ID NO: 1893 - RNA, 29 nt, Artificial Sequence
  Synthetic
acuaccucuauaugaaagaggacuaaaac

SEQ ID NO: 1894 - RNA, 47 nt, Artificial Sequence
  Synthetic
  misc_feature (1)..(47): /note="Variant nucleotides given in the sequence have no preference with respect to those in the annotations for variant positions"
  modified_base (30)..(47): a, c, u, g, unknown or other
  variation (45)..(47): /replace=" "
acuaccucuauaugaaagaggacuaaaacnnnnnnnnnnnnnnnnnn

SEQ ID NO: 1895 - RNA, 56 nt, Artificial Sequence
  Synthetic
  source (1)..(56): /note="Description of Artificial Sequence: Synthetic oligonucleotide"
  modified_base (1)..(28): a, c, u, g, unknown or other
  misc_feature (1)..(56): /note="Variant nucleotides given in the sequence have no preference with respect to those in the annotations for variant positions"
  variation (15)..(28): /replace=" "
nnnnnnnnnnnnnnnnnnnnnnnnnnnnccaccccaauaucgaaggggacuaaaac

SEQ ID NO: 1896 - RNA, 56 nt, Artificial Sequence; identical to SEQ ID NO: 1895
  Synthetic
  source (1)..(56): /note="Description of Artificial Sequence: Synthetic oligonucleotide"
  modified_base (1)..(28): a, c, u, g, unknown or other
  misc_feature (1)..(56): /note="Variant nucleotides given in the sequence have no preference with respect to those in the annotations for variant positions"
  variation (15)..(28): /replace=" "

SEQ ID NO: 1897 - RNA, 28 nt, Artificial Sequence
  Synthetic
ccaccccaauaucgaaggggacuaaaac

SEQ ID NO: 1898 - RNA, 56 nt, Artificial Sequence
  Synthetic
  source (1)..(56): /note="Description of Artificial Sequence: Synthetic oligonucleotide"
  misc_feature (1)..(56): /note="Variant nucleotides given in the sequence have no preference with respect to those in the annotations for variant positions"
  modified_base (29)..(56): a, c, u, g, unknown or other
  variation (43)..(56): /replace=" "
ccaccccaauaucgaaggggacuaaaacnnnnnnnnnnnnnnnnnnnnnnnnnnnn

SEQ ID NO: 1899 - RNA, 50 nt, Artificial Sequence
  Synthetic
aggugaaggucguccguacgaagguacccagaccgcuaaacugaaaguua

SEQ ID NO: 1900 - DNA, 65 bp, Artificial Sequence
  Synthetic
atatcaatatggattacttggtagaacagcaatctagttttagtccccttcgatattggggtgct

SEQ ID NO: 1901 - RNA, 29 nt, Artificial Sequence
  Synthetic
ccgucugucguauccagcugcaaacuucc

SEQ ID NO: 1902 - RNA, 29 nt, Artificial Sequence
  Synthetic
gucguauccagcugcaaacuuccagacaa

SEQ ID NO: 1903 - RNA, 29 nt, Artificial Sequence
  Synthetic
guuagauggccgucugucguauccagcug

SEQ ID NO: 1904 - RNA, 29 nt, Artificial Sequence
  Synthetic
cagacaacgugcaacauaucgcgacguau

SEQ ID NO: 1905 - RNA, 70 nt, Artificial Sequence
  Synthetic
uacccggggauccucuagaaauauggauuacuugguagaacagcaaucuacucgaccugcaggcaugcaa

SEQ ID NO: 1906 - RNA, 56 nt, Artificial Sequence; identical to SEQ ID NO: 72
  Synthetic

SEQ ID NO: 1907 - RNA, 58 nt, Artificial Sequence
  Synthetic
ggccagugaauucgagcucgguacccggggauccucuagaaauauggauuacuuggua

SEQ ID NO: 1908 - RNA, 79 nt, Artificial Sequence
  Synthetic
gaacagcaaucuacucgaccugcaggcaugcaagcuuggcguaaucauggucauagcuguuuccuguguuuauccgcuc

SEQ ID NO: 1909 - RNA, 36 nt, Artificial Sequence
  Synthetic
acaauuccacacaacauacgagccggaagcauaaag

SEQ ID NO: 1910 - RNA, 53 nt, Artificial Sequence
  Synthetic
gugaauucgagcucgguacccggggauccucuagaaauauggauuacuuggua

SEQ ID NO: 1911 - RNA, 56 nt, Artificial Sequence; identical to SEQ ID NO: 72
  Synthetic

SEQ ID NO: 1912 - RNA, 24 nt, Artificial Sequence
  Synthetic
uagauugcuguucuaccaaguaau

SEQ ID NO: 1913 - RNA, 23 nt, Artificial Sequence
  Synthetic
uagauugcuguucuaccaaguaa

SEQ ID NO: 1914 - RNA, 12 nt, Artificial Sequence
  Synthetic
uagauugcuguu

SEQ ID NO: 1915 - RNA, 28 nt, Artificial Sequence
  Synthetic
ccaccccaauaucgaaggggacuaaaac

SEQ ID NO: 1916 - RNA, 36 nt, Artificial Sequence
  Synthetic
gauauagaccaccccaauaucgaaggggacuaaaac

SEQ ID NO: 1917 - RNA, 56 nt, Artificial Sequence; identical to SEQ ID NO: 72
  Synthetic

SEQ ID NO: 1918 - RNA, 28 nt, Artificial Sequence
  Synthetic
ccacccgaauaucgaacgggacuaaaac

SEQ ID NO: 1919 - RNA, 28 nt, Artificial Sequence
  Synthetic
ccaccgcaauaucgaagcggacuaaaac

SEQ ID NO: 1920 - RNA, 28 nt, Artificial Sequence
  Synthetic
ccacgccaauaucgaaggcgacuaaaac

SEQ ID NO: 1921 - RNA, 28 nt, Artificial Sequence
  Synthetic
ccagcccaauaucgaagggcacuaaaac

SEQ ID NO: 1922 - RNA, 28 nt, Artificial Sequence
  Synthetic
ccaggggaauaucgaaccccacuaaaac

SEQ ID NO: 1923 - RNA, 29 nt, Artificial Sequence
  Synthetic
ccaccaccaauaucgaaggggacuaaaac

SEQ ID NO: 1924 - RNA, 28 nt, Artificial Sequence
  Synthetic
ccaacccaauaucgaaggggacuaaaac

SEQ ID NO: 1925 - RNA, 28 nt, Artificial Sequence
  Synthetic
ccacccaaauaucgaaggggacuaaaac

SEQ ID NO: 1926 - RNA, 30 nt, Artificial Sequence
  Synthetic
ccacccccaauaucgaagggggacuaaaac

SEQ ID NO: 1927 - RNA, 28 nt, Artificial Sequence
  Synthetic
ccaccccaauaucgaaggggacuaaaac

SEQ ID NO: 1928 - RNA, 28 nt, Artificial Sequence
  Synthetic
ccacccgaauaucgaacgggacuaaaac

SEQ ID NO: 1929 - RNA, 28 nt, Artificial Sequence
  Synthetic
ccaccgcaauaucgaagcggacuaaaac

SEQ ID NO: 1930 - RNA, 28 nt, Artificial Sequence
  Synthetic
ccacgccaauaucgaaggcgacuaaaac

SEQ ID NO: 1931 - RNA, 28 nt, Artificial Sequence
  Synthetic
ccagcccaauaucgaagggcacuaaaac

SEQ ID NO: 1932 - RNA, 28 nt, Artificial Sequence
  Synthetic
ccaggggaauaucgaaccccacuaaaac

SEQ ID NO: 1933 - RNA, 29 nt, Artificial Sequence
  Synthetic
ccaccaccaauaucgaaggggacuaaaac

SEQ ID NO: 1934 - RNA, 28 nt, Artificial Sequence
  Synthetic
ccaacccaauaucgaaggggacuaaaac

SEQ ID NO: 1935 - RNA, 28 nt, Artificial Sequence
  Synthetic
ccacccaaauaucgaaggggacuaaaac

SEQ ID NO: 1936 - RNA, 30 nt, Artificial Sequence; identical to SEQ ID NO: 1926
  Synthetic

SEQ ID NO: 1937 - RNA, 28 nt, Artificial Sequence
  Synthetic
ccaccccaauaucgaaggggacuaaaac

SEQ ID NO: 1938 - RNA, 27 nt, Artificial Sequence
  Synthetic
ccaccccauaucgaaggggacuaaaac

SEQ ID NO: 1939 - RNA, 25 nt, Artificial Sequence
  Synthetic
ccaccccaucgaaggggacuaaaac

SEQ ID NO: 1940 - RNA, 21 nt, Artificial Sequence
  Synthetic
ccaccccaaggggacuaaaac

SEQ ID NO: 1941 - RNA, 29 nt, Artificial Sequence
  Synthetic
ccaccccaaauaucgaaggggacuaaaac

SEQ ID NO: 1942 - RNA, 31 nt, Artificial Sequence
  Synthetic
ccaccccaaaaauaucgaaggggacuaaaac

SEQ ID NO: 1943 - RNA, 35 nt, Artificial Sequence
  Synthetic
ccaccccaaaaaaaaauauggaaggggacuaaaac

SEQ ID NO: 1944 - RNA, 28 nt, Artificial Sequence
  Synthetic
ccaccccgauaucgaaggggacuaaaac

SEQ ID NO: 1945 - RNA, 28 nt, Artificial Sequence
  Synthetic
ccaccccaaaaucgaaggggacuaaaac

SEQ ID NO: 1946 - RNA, 28 nt, Artificial Sequence
  Synthetic
ccaccccaauauccaaggggacuaaaac

SEQ ID NO: 1947 - RNA, 28 nt, Artificial Sequence
  Synthetic
ccaccccaauaucgaaggggacuaaaac

SEQ ID NO: 1948 - RNA, 27 nt, Artificial Sequence
  Synthetic
ccaccccauacugaaggggacuaaaac

SEQ ID NO: 1949 - RNA, 25 nt, Artificial Sequence
  Synthetic
ccaccccaugcaaggggacuaaaac

SEQ ID NO: 1950 - RNA, 21 nt, Artificial Sequence
  Synthetic
ccaccccaaggggacuaaaac

SEQ ID NO: 1951 - RNA, 29 nt, Artificial Sequence
  Synthetic
ccaccccaaauuacgaaggggacuaaaac

SEQ ID NO: 1952 - RNA, 31 nt, Artificial Sequence
  Synthetic
ccaccccaaaaaauucgaaggggacuaaaac

SEQ ID NO: 1953 - RNA, 35 nt, Artificial Sequence
  Synthetic
ccaccccaaaaaaaaauaucgaaggggacuaaaac

SEQ ID NO: 1954 - RNA, 28 nt, Artificial Sequence
  Synthetic
ccaccccgauaucgaaggggacuaaaac

SEQ ID NO: 1955 - RNA, 28 nt, Artificial Sequence
  Synthetic
ccaccccaaaaucgaaggggacuaaaac

SEQ ID NO: 1956 - RNA, 28 nt, Artificial Sequence
  Synthetic
ccaccccaauauccaaggggacuaaaac

SEQ ID NO: 1957 - RNA, 55 nt, Artificial Sequence
  Synthetic
aucaaguuagauggccgucugucguauccagcugcaaacuuccagacaacgugca

SEQ ID NO: 1958 - RNA, 56 nt, Artificial Sequence
  Synthetic
ccaccccaauaucgaaggggacuaaaacaaguuugcagcuggauacgacagacggc

SEQ ID NO: 1959 - DNA, 33 bp, Artificial Sequence
  Synthetic
ggtccgctgccgttcgcttgggacatcctgtcc

SEQ ID NO: 1960 - DNA, 70 bp, Artificial Sequence
  Synthetic
ataggccagtgaattcgagctcgaatatggattacttggtagaacagcaatctacgccggaagcataaag

SEQ ID NO: 1961 - DNA, 173 bp, Artificial Sequence
  Synthetic
ggccagtgaattcgagctcggtacccggggatcctctagaaatatggattacttggtagaacaccaatctactcgacctgcaggcatgcaagcttggcgtaatcatggtcatagctgtttcctgtgtttatccgctcacaattccacacaacatacgagccggaagcataaag

SEQ ID NO: 1962 - protein, 16 aa, Lactococcus lactis
LQKFTGDIENLVKASL

SEQ ID NO: 1963 - protein, 15 aa, Lactococcus lactis
WIRAGWFIRNRSAHY

SEQ ID NO: 1964 - protein, 16 aa, Lactococcus lactis
LQKFTGDIENLVKASL

SEQ ID NO: 1965 - protein, 15 aa, Lactococcus lactis
WIRAGWFIRNRSAHY

SEQ ID NO: 1966 - protein, 16 aa, Thermus aquaticus
PLEERGVAEAWLNAKV

SEQ ID NO: 1967 - protein, 10 aa, Thermus aquaticus
ADLRNDVAHA

SEQ ID NO: 1968 - protein, 16 aa, Thermus aquaticus
PLEERGVAEAWLNAKV

SEQ ID NO: 1969 - protein, 10 aa, Thermus aquaticus
ADLRNDVAHA

SEQ ID NO: 1970 - protein, 16 aa, Mycobacterium tuberculosis
RSATPAITIVLRAAVA

SEQ ID NO: 1971 - protein, 15 aa, Mycobacterium tuberculosis
LGRFESRVRNTAAHE

SEQ ID NO: 1972 - protein, 16 aa, Mycobacterium tuberculosis
RSATPAITIVLRAAVA

SEQ ID NO: 1973 - protein, 15 aa, Mycobacterium tuberculosis
LGRFESRVRNTAAHE

SEQ ID NO: 1974 - protein, 16 aa, Escherichia coli
LYPELRTIEGVLKSKM

SEQ ID NO: 1975 - protein, 14 aa, Escherichia coli
AYTFFNVERHSLFH

SEQ ID NO: 1976 - protein, 16 aa, Escherichia coli
LYPELRTIEGVLKSKM

SEQ ID NO: 1977 - protein, 14 aa, Escherichia coli
AYTFFNVERHSLFH

SEQ ID NO: 1978 - protein, 16 aa, Homo sapiens
GNELPLAVASTADLIR

SEQ ID NO: 1979 - protein, 15 aa, Homo sapiens
IPDWIVDLRHELTHK

SEQ ID NO: 1980 - protein, 16 aa, Homo sapiens
GNELPLAVASTADLIR

SEQ ID NO: 1981 - protein, 15 aa, Homo sapiens
IPDWIVDLRHELTHK

SEQ ID NO: 1982 - protein, 16 aa, Thermus thermophilus
IQRFEYTFEAFWKALQ

SEQ ID NO: 1983 - protein, 15 aa, Thermus thermophilus
  MOD_RES (5)..(5): Any amino acid
LALGXVDDRSLTVHT

SEQ ID NO: 1984 - protein, 16 aa, Thermus thermophilus
IQRFEYTFEAFWKALQ

SEQ ID NO: 1985 - protein, 15 aa, Thermus thermophilus
  MOD_RES (5)..(5): Any amino acid
LALGXVDDRSLTVHT

SEQ ID NO: 1986 - protein, 16 aa, Unknown
  Synthetic
  source (1)..(16): /note="Description of Unknown: Lachnospiraceae bacterium"
DYEIIKAEESLQRDIS

SEQ ID NO: 1987 - protein, 15 aa, Unknown
  Synthetic
  source (1)..(15): /note="Description of Unknown: Lachnospiraceae bacterium"
LKSMLYSMRNSSFHF

SEQ ID NO: 1988 - protein, 16 aa, Unknown
  Synthetic
  source (1)..(16): /note="Description of Unknown: Lachnospiraceae bacterium"
LIKWCYLRERDLMYFQ

SEQ ID NO: 1989 - protein, 14 aa, Unknown
  Synthetic
  source (1)..(14): /note="Description of Unknown: Lachnospiraceae bacterium"
FRNEIDHFHYFYDR

SEQ ID NO: 1990 - protein, 16 aa, Unknown
  Synthetic
  source (1)..(16): /note="Description of Unknown: Lachnospiraceae bacterium"
DYELIKAEEMLQRETA

SEQ ID NO: 1991 - protein, 15 aa, Unknown
  Synthetic
  source (1)..(15): /note="Description of Unknown: Lachnospiraceae bacterium"
LKDVIYSMRNDSFHY

SEQ ID NO: 1992 - protein, 16 aa, Unknown
  Synthetic
  source (1)..(6): /note="Description of Unknown: Lachnospiraceae bacterium"
LINWIYLRERDLMNFQ

SEQ ID NO: 1993 - protein, 14 aa, Unknown
  Synthetic
  source (1)..(14): /note="Description of Unknown: Lachnospiraceae bacterium"
LRNYIEHFRYYSSF

SEQ ID NO: 1994 - protein, 16 aa, Clostridium aminophilum
DYEQIRADETLQRQLS

SEQ ID NO: 1995 - protein, 15 aa, Clostridium aminophilum
LRKAIYSLRNETFHF

SEQ ID NO: 1996 - protein, 16 aa, Clostridium aminophilum
LISWSFLRERDLLYFQ

SEQ ID NO: 1997 - protein, 14 aa, Clostridium aminophilum
VRKYVDHFKYYATS

SEQ ID NO: 1998 - protein, 16 aa, Unknown
  Synthetic
  source (1)..(16): /note="Description of Unknown: Lachnospiraceae bacterium"
DYEQIKADEMLQREVA

SEQ ID NO: 1999 - protein, 15 aa, Unknown
  Synthetic
  source (1)..(15): /note="Description of Unknown: Lachnospiraceae bacterium"
IIQIIYSLRNKSFHF

SEQ ID NO: 2000 - protein, 16 aa, Unknown
  Synthetic
  source (1)..(16): /note="Description of Unknown: Lachnospiraceae bacterium"
LISWSYLRERDLLYFQ

SEQ ID NO: 2001 - protein, 14 aa, Unknown
  Synthetic
  source (1)..(14): /note="Description of Unknown: Lachnospiraceae bacterium"
LRKYVDHFKYYAYG

SEQ ID NO: 2002 - protein, 16 aa, Carnobacterium gallinarum
KLQEIGIYEGFQTKFM

SEQ ID NO: 2003 - protein, 15 aa, Carnobacterium gallinarum
LRGSVQQIRNEIFHS

SEQ ID NO: 2004 - protein, 16 aa, Carnobacterium gallinarum
MVGFSALFERDLVYFS

SEQ ID NO: 2005 - protein, 14 aa, Carnobacterium gallinarum
IRNQTAHLSVLQLE

SEQ ID NO: 2006 - protein, 16 aa, Carnobacterium gallinarum
TLQEIGMYEGFQTKFM

SEQ ID NO: 2007 - protein, 15 aa, Carnobacterium gallinarum
IRGAVQRVRNQIFHQ

SEQ ID NO: 2008 - protein, 16 aa, Carnobacterium gallinarum
MVGFSVLFERDFVYMG

SEQ ID NO: 2009 - protein, 14 aa, Carnobacterium gallinarum
IRNNIAHLHVLRND

SEQ ID NO: 2010 - protein, 16 aa, Paludibacter propionicigenes
DLIRIKTNEAFVLNLT

SEQ ID NO: 2011 - protein, 15 aa, Paludibacter propionicigenes
IRGAVQQIRNNVNHY

SEQ ID NO: 2012 - protein, 16 aa, Paludibacter propionicigenes
MAGFVALFDRDFQFFD

SEQ ID NO: 2013 - protein, 14 aa, Paludibacter propionicigenes
IRNHIAHFNYLTKD

SEQ ID NO: 2014 - protein, 16 aa, Listeria seeligeri
SLQKIKIEEAFALKFI

SEQ ID NO: 2015 - protein, 15 aa, Listeria seeligeri
LRGAIAPIRNEIIHL

SEQ ID NO: 2016 - protein, 16 aa, Listeria seeligeri
LAGYMSIADRDFQFSS

SEQ ID NO: 2017 - protein, 14 aa, Listeria seeligeri
KRNNISHFNYLNGQ

SEQ ID NO: 2018 - protein, 16 aa, Listeria weihenstephanensis
DLQDIRSGEAFSFKFI

SEQ ID NO: 2019 - protein, 15 aa, Listeria weihenstephanensis
IRGSIQQIRNEVYHC

SEQ ID NO: 2020 - protein, 16 aa, Listeria weihenstephanensis
YVGYVAIADRDFQCMA

SEQ ID NO: 2021 - protein, 14 aa, Listeria weihenstephanensis
ARNHIAHLNYLSLK

SEQ ID NO: 2022 - protein, 16 aa, Listeria newyorkensis
DLQDIRSGEAFSFKFI

SEQ ID NO: 2023 - protein, 15 aa, Listeria newyorkensis
IRGSIQQIRNEVYHC

SEQ ID NO: 2024 - protein, 16 aa, Listeria newyorkensis
YVGYVAIADRDFQCMA

SEQ ID NO: 2025 - protein, 14 aa, Listeria newyorkensis
ARNHIAHLNYLSLK

SEQ ID NO: 2026 - protein, 16 aa, Leptotrichia wadei
DLEYIKTKETLIRKMA

SEQ ID NO: 2027 - protein, 15 aa, Leptotrichia wadei
ISYSIYNVRNGVGHF

SEQ ID NO: 2028 - protein, 16 aa, Leptotrichia wadei
NVAFFNKWERDFKFIV

SEQ ID NO: 2029 - protein, 14 aa, Leptotrichia wadei
FRNYIAHFLHLHTK

SEQ ID NO: 2030 - protein, 16 aa, Leptotrichia wadei
INMRNRQTEAFLRSII

SEQ ID NO: 2031 - protein, 15 aa, Leptotrichia wadei
MLNAITSIRHRVVHY

SEQ ID NO: 2032 - protein, 16 aa, Leptotrichia wadei
LAGYTSLWERDLQFKL

SEQ ID NO: 2033 - protein, 14 aa, Leptotrichia wadei
IRNYIAHFNYIPDA

SEQ ID NO: 2034 - protein, 16 aa, Leptotrichia wadei
FIARNRQNEAFLRNII

SEQ ID NO: 2035 - protein, 15 aa, Leptotrichia wadei
IDEAISSIRHGIVHF

SEQ ID NO: 2036 - protein, 16 aa, Leptotrichia wadei
LVGYTSIWERDLRFRL

SEQ ID NO: 2037 - protein, 14 aa, Leptotrichia wadei
IRNYIAHFNYIPHA

SEQ ID NO: 2038 - protein, 16 aa, Rhodobacter capsulatus
GQTEIKESEIFVRLWV

SEQ ID NO: 2039 - protein, 15 aa, Rhodobacter capsulatus
LLRYLRGCRNQTFHL

SEQ ID NO: 2040 - protein, 16 aa, Rhodobacter capsulatus
LIDYAGAYERDTGTFL

SEQ ID NO: 2041 - protein, 14 aa, Rhodobacter capsulatus
TRKDLAHFNVLDRA

SEQ ID NO: 2042 - protein, 16 aa, Leptotrichia buccalis
FIARNRQNEAFLRNII

SEQ ID NO: 2043 - protein, 15 aa, Leptotrichia buccalis
IDEAISSIRHGIVHF

SEQ ID NO: 2044 - protein, 16 aa, Leptotrichia buccalis
LVGYTSIWERDLRFRL

SEQ ID NO: 2045 - protein, 14 aa, Leptotrichia buccalis
IRNYIAHFNYIPHA

SEQ ID NO: 2046 - protein, 16 aa, Leptotrichia sp.
FIVGNRQNEAFLRNII

SEQ ID NO: 2047 - protein, 15 aa, Leptotrichia sp.
IDEAISSIRHGIVHF

SEQ ID NO: 2048 - protein, 16 aa, Leptotrichia sp.
LVGYTSIWERDLRFRL

SEQ ID NO: 2049 - protein, 14 aa, Leptotrichia sp.
IRNYIAHFNYIPNA

SEQ ID NO: 2050 - protein, 16 aa, Leptotrichia sp.
DFSRLHAKEELDLELI

SEQ ID NO: 2051 - protein, 15 aa, Leptotrichia sp.
FQKEGYLLRNKILHN

SEQ ID NO: 2052 - protein, 16 aa, Leptotrichia sp.
LAIQMARFERDMHYIV

SEQ ID NO: 2053 - protein, 14 aa, Leptotrichia sp.
IRNYISHFYIVRNP

SEQ ID NO: 2054 - protein, 16 aa, Leptotrichia shahii
DFSRLHAKEELDLELI

SEQ ID NO: 2055 - protein, 15 aa, Leptotrichia shahii
FTKIGTNERNRILHA

SEQ ID NO: 2056 - protein, 16 aa, Leptotrichia shahii
LAIQMARFERDMHYIV

SEQ ID NO: 2057 - protein, 14 aa, Leptotrichia shahii
IRNYISHFYIVRNP

SEQ ID NO: 2058 - RNA, 56 nt, Artificial Sequence; identical to SEQ ID NO: 1958
  Synthetic

SEQ ID NO: 2059 - RNA, 56 nt, Artificial Sequence; identical to SEQ ID NO: 1958
  Synthetic

SEQ ID NO: 2060 - RNA, 56 nt, Artificial Sequence; identical to SEQ ID NO: 72
  Synthetic

SEQ ID NO: 2061 - RNA, 56 nt, Artificial Sequence; identical to SEQ ID NO: 72
  Synthetic

SEQ ID NO: 2062 - RNA, 173 nt, Artificial Sequence; identical to SEQ ID NO: 142
  Synthetic

SEQ ID NO: 2063 - RNA, 28 nt, Artificial Sequence
  Synthetic
uagauugcuguucuaccaaguaauccau

SEQ ID NO: 2064 - RNA, 176 nt, Artificial Sequence; identical to SEQ ID NO: 145
  Synthetic

SEQ ID NO: 2065 - RNA, 28 nt, Artificial Sequence
  Synthetic
uagauugcuguucuaccaaguaauccau

SEQ ID NO: 2066 - RNA, 176 nt, Artificial Sequence; identical to SEQ ID NO: 146
  Synthetic

SEQ ID NO: 2067 - RNA, 28 nt, Artificial Sequence
  Synthetic
uagauugcuguucuaccaaguaauccau

SEQ ID NO: 2068 - RNA, 173 nt, Artificial Sequence; identical to SEQ ID NO: 142
  Synthetic

SEQ ID NO: 2069 - RNA, 28 nt, Artificial Sequence
  Synthetic
uagauugcuguucuaccaaguaauccau

SEQ ID NO: 2070 - RNA, 176 nt, Artificial Sequence; identical to SEQ ID NO: 146
  Synthetic

SEQ ID NO: 2071 - RNA, 28 nt, Artificial Sequence
  Synthetic
uagauugcuguucuaccaaguaauccau

SEQ ID NO: 2072 - DNA, 40 bp, Artificial Sequence
  Synthetic
gtcaggtcggtactaacatcaagttagatggccgtctgtc

SEQ ID NO: 2073 - DNA, 28 bp, Artificial Sequence
  Synthetic
gacagacggccatctaacttgatgttag

SEQ ID NO: 2074 - DNA, 28 bp, Artificial Sequence
  Synthetic
gacggccatctaacttgatgttagtacc

SEQ ID NO: 2075 - DNA, 28 bp, Artificial Sequence
  Synthetic
gccatctaacttgatgttagtaccgacc

SEQ ID NO: 2076 - DNA, 28 bp, Artificial Sequence
  Synthetic
tctaacttgatgttagtaccgacctgac

SEQ ID NO: 2077 - RNA, 29 nt, Artificial Sequence
  Synthetic
ccgucugucguauccagcugcaaacuucc

SEQ ID NO: 2078 - RNA, 29 nt, Artificial Sequence
  Synthetic
gucguauccagcugcaaacuuccagacaa

SEQ ID NO: 2079 - RNA, 29 nt, Artificial Sequence
  Synthetic
guuagauggccgucugucguauccagcug

SEQ ID NO: 2080 - RNA, 29 nt, Artificial Sequence
  Synthetic
cagacaacgugcaacauaucgcgacguau

SEQ ID NO: 2081 - RNA, 70 nt, Artificial Sequence; identical to SEQ ID NO: 1905
  Synthetic

SEQ ID NO: 2082 - RNA, 56 nt, Artificial Sequence; identical to SEQ ID NO: 72
  Synthetic

SEQ ID NO: 2083 - RNA, 125 nt, Artificial Sequence
  Synthetic
gagcucgguacccggggauccucuagaaauauggauuacuugguagaacagcaaucuacucgaccugcaggcaugcaagcuuggcguaaucauggucauagcuguuuccuguguuuauccgcuca

SEQ ID NO: 2084 - RNA, 173 nt, Artificial Sequence; identical to SEQ ID NO: 142
  Synthetic

SEQ ID NO: 2085 - RNA, 28 nt, Artificial Sequence
  Synthetic
uagauugcuguucuaccaaguaauccau

SEQ ID NO: 2086 - RNA, 176 nt, Artificial Sequence; identical to SEQ ID NO: 145
  Synthetic

SEQ ID NO: 2087 - RNA, 28 nt, Artificial Sequence
  Synthetic
uagauugcuguucuaccaaguaauccau

SEQ ID NO: 2088 - RNA, 176 nt, Artificial Sequence; identical to SEQ ID NO: 146
  Synthetic

SEQ ID NO: 2089 - RNA, 28 nt, Artificial Sequence
  Synthetic
uagauugcuguucuaccaaguaauccau

SEQ ID NO: 2090 - RNA, 55 nt, Artificial Sequence; identical to SEQ ID NO: 1957
  Synthetic

SEQ ID NO: 2091 - RNA, 56 nt, Artificial Sequence; identical to SEQ ID NO: 1958
  Synthetic

SEQ ID NO: 2092 - RNA, 56 nt, Artificial Sequence; identical to SEQ ID NO: 72
  Synthetic

SEQ ID NO: 2093 - RNA, 24 nt, Artificial Sequence
  Synthetic
uagauugcuguucuaccaaguaau

SEQ ID NO: 2094 - RNA, 23 nt, Artificial Sequence
  Synthetic
uagauugcuguucuaccaaguaa

SEQ ID NO: 2095 - RNA, 12 nt, Artificial Sequence
  Synthetic
uagauugcuguu

SEQ ID NO: 2096 - RNA, 56 nt, Artificial Sequence; identical to SEQ ID NO: 72
  Synthetic

SEQ ID NO: 2097 - RNA, 28 nt, Artificial Sequence
  Synthetic
ccacccgaauaucgaacgggacuaaaac

SEQ ID NO: 2098 - RNA, 28 nt, Artificial Sequence
  Synthetic
ccaccgcaauaucgaagcggacuaaaac

SEQ ID NO: 2099 - RNA, 28 nt, Artificial Sequence
  Synthetic
ccacgccaauaucgaaggcgacuaaaac

SEQ ID NO: 2100 - RNA, 28 nt, Artificial Sequence
  Synthetic
ccagcccaauaucgaagggcacuaaaac

SEQ ID NO: 2101 - RNA, 28 nt, Artificial Sequence
  Synthetic
ccaggggaauaucgaaccccacuaaaac

SEQ ID NO: 2102 - RNA, 29 nt, Artificial Sequence
  Synthetic
ccaccaccaauaucgaaggggacuaaaac

SEQ ID NO: 2103 - RNA, 28 nt, Artificial Sequence
  Synthetic
ccaacccaauaucgaaggggacuaaaac

SEQ ID NO: 2104 - RNA, 28 nt, Artificial Sequence
  Synthetic
ccacccaaauaucgaaggggacuaaaac

SEQ ID NO: 2105 - RNA, 30 nt, Artificial Sequence; identical to SEQ ID NO: 1926
  Synthetic

SEQ ID NO: 2106 - RNA, 28 nt, Artificial Sequence
  Synthetic
ccaccccaauaucgaaggggacuaaaac

SEQ ID NO: 2107 - RNA, 27 nt, Artificial Sequence
  Synthetic
ccaccccauaucgaaggggacuaaaac

SEQ ID NO: 2108 - RNA, 25 nt, Artificial Sequence
  Synthetic
ccaccccaucgaaggggacuaaaac

SEQ ID NO: 2109 - RNA, 21 nt, Artificial Sequence
  Synthetic
ccaccccaaggggacuaaaac

SEQ ID NO: 2110 - RNA, 29 nt, Artificial Sequence
  Synthetic
ccaccccaaauaucgaaggggacuaaaac

SEQ ID NO: 2111 - RNA, 31 nt, Artificial Sequence; identical to SEQ ID NO: 1942
  Synthetic

SEQ ID NO: 2112 - RNA, 35 nt, Artificial Sequence; identical to SEQ ID NO: 1953
  Synthetic

SEQ ID NO: 2113 - RNA, 28 nt, Artificial Sequence
  Synthetic
ccaccccgauaucgaaggggacuaaaac

SEQ ID NO: 2114 - RNA, 28 nt, Artificial Sequence
  Synthetic
ccaccccaaaaucgaaggggacuaaaac

SEQ ID NO: 2115 - RNA, 28 nt, Artificial Sequence
  Synthetic
ccaccccaauauccaaggggacuaaaac

SEQ ID NO: 2116 - RNA, 56 nt, Artificial Sequence; identical to SEQ ID NO: 1958
  Synthetic

SEQ ID NO: 2117 - RNA, 28 nt, Artificial Sequence
  Synthetic
uaguuugcagcuggauacgacagacggc

SEQ ID NO: 2118 - RNA, 28 nt, Artificial Sequence
  Synthetic
aaguaugcagcuggauacgacagacggc

SEQ ID NO: 2119 - RNA, 28 nt, Artificial Sequence
  Synthetic
aaguuugcugcuggauacgacagacggc

SEQ ID NO: 2120 - RNA, 28 nt, Artificial Sequence
  Synthetic
aaguuugcagcucgauacgacagacggc

SEQ ID NO: 2121 - RNA, 28 nt, Artificial Sequence
  Synthetic
aaguuugcagcuggauucgacagacggc

SEQ ID NO: 2122 - RNA, 28 nt, Artificial Sequence
  Synthetic
aaguuugcagcuggauacgagagacggc

SEQ ID NO: 2123 - RNA, 28 nt, Artificial Sequence
  Synthetic
aaguuugcagcuggauacgacagagggc

SEQ ID NO: 2124 - RNA, 56 nt, Artificial Sequence; identical to SEQ ID NO: 1958
  Synthetic

SEQ ID NO: 2125 - RNA, 28 nt, Artificial Sequence
  Synthetic
uuguuugcagcuggauacgacagacggc

SEQ ID NO: 2126 - RNA, 28 nt, Artificial Sequence
  Synthetic
aaguuaccagcuggauacgacagacggc

SEQ ID NO: 2127 - RNA, 28 nt, Artificial Sequence
  Synthetic
aaguuugcaggaggauacgacagacggc

SEQ ID NO: 2128 - RNA, 28 nt, Artificial Sequence
  Synthetic
aaguuugcagcuggaaucgacagacggc

SEQ ID NO: 2129 - RNA, 28 nt, Artificial Sequence
  Synthetic
aaguuugcagcuggauacgagcgacggc

SEQ ID NO: 2130 - RNA, 56 nt, Artificial Sequence; identical to SEQ ID NO: 72
  Synthetic

SEQ ID NO: 2131 - RNA, 28 nt, Artificial Sequence
  Synthetic
aagauugcuguucuaccaaguaauccau

SEQ ID NO: 2132 - RNA, 28 nt, Artificial Sequence
  Synthetic
uagaaugcuguucuaccaaguaauccau

SEQ ID NO: 2133 - RNA, 28 nt, Artificial Sequence
  Synthetic
uagauugcaguucuaccaaguaauccau

SEQ ID NO: 2134 - RNA, 28 nt, Artificial Sequence
  Synthetic
uagauugcuguuguaccaaguaauccau

SEQ ID NO: 2135 - RNA, 28 nt, Artificial Sequence
  Synthetic
uagauugcuguucuacgaaguaauccau

SEQ ID NO: 2136 - RNA, 28 nt, Artificial Sequence
  Synthetic
uagauugcuguucuaccaagaaauccau

SEQ ID NO: 2137 - RNA, 28 nt, Artificial Sequence
  Synthetic
uagauugcuguucuaccaaguaaugcau

SEQ ID NO: 2138 - RNA, 28 nt, Artificial Sequence
  Synthetic
uagauugcuguucuaccaaguaauccaa

SEQ ID NO: 2139 - RNA, 56 nt, Artificial Sequence; identical to SEQ ID NO: 72
  Synthetic

SEQ ID NO: 2140 - RNA, 28 nt, Artificial Sequence
  Synthetic
augauugcuguucuaccaaguaauccau

SEQ ID NO: 2141 - RNA, 28 nt, Artificial Sequence
  Synthetic
uagauaccuguucuaccaaguaauccau

SEQ ID NO: 2142 - RNA, 28 nt, Artificial Sequence
  Synthetic
uagauugcugaacuaccaaguaauccau

SEQ ID NO: 2143 - RNA, 28 nt, Artificial Sequence
  Synthetic
uagauugcuguuguaggaaguaauccau

SEQ ID NO: 2144 - RNA, 28 nt, Artificial Sequence
  Synthetic
uagauugcuguucuaccaagauauccau

SEQ ID NO: 2145 - RNA, 28 nt, Artificial Sequence
  Synthetic
uagauugcuguucuaccaaguaaucguu

SEQ ID NO: 2146 - RNA, 60 nt, Artificial Sequence
  Synthetic
uucgaaaucgaaggugaaggugaaggucguccguacgaagguacccagaccgcuaaacug

SEQ ID NO: 2147 - RNA, 60 nt, Artificial Sequence
  Synthetic
aaacugucccuuccggaagguuucaaaugggaacguguuaugaacuucgaagacgguggu

SEQ ID NO: 2148 - RNA, 60 nt, Artificial Sequence
  Synthetic
ccaggacuccucccugcaagacggugaguucaucuacaaaguuaaacugcgugguaccaa

SEQ ID NO: 2149 - RNA, 28 nt, Artificial Sequence
  Synthetic
ccaccccaauaucgaaggggacuaaaac

SEQ ID NO: 2150 - RNA, 56 nt, Artificial Sequence; identical to SEQ ID NO: 1898
  Synthetic
  misc_feature (1)..(56): /note="Variant nucleotides given in the sequence have no preference with respect to those in the annotations for variant positions"
  modified_base (29)..(56): a, c, u, g, unknown or other
  variation (43)..(56): /replace=" "

SEQ ID NO: 2151 - RNA, 29 nt, Artificial Sequence
  Synthetic
cgccuuacaagaaguucgcugaacaagca

SEQ ID NO: 2152 - RNA, 29 nt, Artificial Sequence
  Synthetic
uucgcuacgaauuccgacugcgagcuuau

SEQ ID NO: 2153 - RNA, 29 nt, Artificial Sequence
  Synthetic
acgggugaguccaucauaagcguugacgc

SEQ ID NO: 2154 - RNA, 29 nt, Artificial Sequence
  Synthetic
aaccguuuuacaucaagaaaccuguugac

SEQ ID NO: 2155 - RNA, 29 nt, Artificial Sequence
  Synthetic
gccgucugucguauccagcugcaaacuuc

SEQ ID NO: 2156 - RNA, 29 nt, Artificial Sequence
  Synthetic
ccgucugucguauccagcugcaaacuucc

SEQ ID NO: 2157 - RNA, 29 nt, Artificial Sequence
  Synthetic
auggccgucugucguauccagcugcaaac

SEQ ID NO: 2158 - RNA, 29 nt, Artificial Sequence
  Synthetic
uuagauggccgucugucguauccagcugc

SEQ ID NO: 2159 - RNA, 29 nt, Artificial Sequence
  Synthetic
guuagauggccgucugucguauccagcug

SEQ ID NO: 2160 - RNA, 29 nt, Artificial Sequence
  Synthetic
cguauccagcugcaaacuuccagacaacg

SEQ ID NO: 2161 - RNA, 29 nt, Artificial Sequence
  Synthetic
aacuuccagacaacgugcaacauaucgcg

SEQ ID NO: 2162 - RNA, 29 nt, Artificial Sequence
  Synthetic
uauccagcugcaaacuuccagacaacgug

SEQ ID NO: 2163 - RNA, 29 nt, Artificial Sequence
  Synthetic
gucguauccagcugcaaacuuccagacaa

SEQ ID NO: 2164 - RNA, 29 nt, Artificial Sequence
  Synthetic
cugcaaacuuccagacaacgugcaacaua

SEQ ID NO: 2165 - RNA, 29 nt, Artificial Sequence
  Synthetic
agauggccgucugucguauccagcugcaa

SEQ ID NO: 2166 - RNA, 29 nt, Artificial Sequence
  Synthetic
ucugucguauccagcugcaaacuuccaga

SEQ ID NO: 2167 - RNA, 29 nt, Artificial Sequence
  Synthetic
ggccgucugucguauccagcugcaaacuu

SEQ ID NO: 2168 - RNA, 29 nt, Artificial Sequence
  Synthetic
cagacaacgugcaacauaucgcgacguau

SEQ ID NO: 2169 - RNA, 29 nt, Artificial Sequence
  Synthetic
aguuagauggccgucugucguauccagcu

SEQ ID NO: 2170 - RNA, 29 nt, Artificial Sequence
  Synthetic
uggccgucugucguauccagcugcaaacu

SEQ ID NO: 2171 - RNA, 29 nt, Artificial Sequence
  Synthetic
ccgucugucguauccagcugcaaacuucc

SEQ ID NO: 2172 - RNA, 29 nt, Artificial Sequence
  Synthetic
gccgucugucguauccagcugcaaacuuc

SEQ ID NO: 2173 - RNA, 28 nt, Artificial Sequence
  Synthetic
uaguuugcagcuggauacgacagacggc

SEQ ID NO: 2174 - RNA, 28 nt, Artificial Sequence
  Synthetic
aaguaugcagcuggauacgacagacggc

SEQ ID NO: 2175 - RNA, 28 nt, Artificial Sequence
  Synthetic
aaguuugcugcuggauacgacagacggc

SEQ ID NO: 2176 - RNA, 28 nt, Artificial Sequence
  Synthetic
aaguuugcagcucgauacgacagacggc

SEQ ID NO: 2177 - RNA, 28 nt, Artificial Sequence
  Synthetic
aaguuugcagcuggauucgacagacggc

SEQ ID NO: 2178 - RNA, 28 nt, Artificial Sequence
  Synthetic
aaguuugcagcuggauacgagagacggc

SEQ ID NO: 2179 - RNA, 29 nt, Artificial Sequence
  Synthetic
aaaguuugcagcuggauacgacagagggc

SEQ ID NO: 2180 - RNA, 28 nt, Artificial Sequence
  Synthetic
uuguuugcagcuggauacgacagacggc

SEQ ID NO: 2181 - RNA, 28 nt, Artificial Sequence
  Synthetic
aaguuaccagcuggauacgacagacggc

SEQ ID NO: 2182 - RNA, 28 nt, Artificial Sequence
  Synthetic
aaguuugcaggaggauacgacagacggc

SEQ ID NO: 2183 - RNA, 28 nt, Artificial Sequence
  Synthetic
aaguuugcagcuggaaucgacagacggc

SEQ ID NO: 2184 - RNA, 28 nt, Artificial Sequence
  Synthetic
aaguuugcagcuggauacgagcgacggc

SEQ ID NO: 2185 - RNA, 28 nt, Artificial Sequence
  Synthetic
aaguuugcagcuggauacgacagacggc

SEQ ID NO: 2186 - RNA, 55 nt, Artificial Sequence
  Synthetic
aucaaguuaggguccgcugccguucgcuugggacauccuguccagacaacgugca

SEQ ID NO: 2187 - RNA, 56 nt, Artificial Sequence
  Synthetic
ccaccccaauaucgaaggggacuaaaacacaggaugucccaagcgaacggcagcgg

SEQ ID NO: 2188 - RNA, 56 nt, Artificial Sequence; identical to SEQ ID NO: 72
  Synthetic

SEQ ID NO: 2189 - RNA, 28 nt, Artificial Sequence
  Synthetic
aagaaugcuguucuaccaaguaauccau

SEQ ID NO: 2190 - RNA, 28 nt, Artificial Sequence
  Synthetic
aagauugcaguucuaccaaguaauccau

SEQ ID NO: 2191 - RNA, 28 nt, Artificial Sequence
  Synthetic
aagauugcuguuguaccaaguaauccau

SEQ ID NO: 2192 - RNA, 28 nt, Artificial Sequence
  Synthetic
uagaaugcaguucuaccaaguaauccau

SEQ ID NO: 2193 - RNA, 28 nt, Artificial Sequence
  Synthetic
uagaaugcuguuguaccaaguaauccau

SEQ ID NO: 2194 - RNA, 28 nt, Artificial Sequence
  Synthetic
uagaaugcuguucuacgaaguaauccau

SEQ ID NO: 2195 - RNA, 28 nt, Artificial Sequence
  Synthetic
uagauugcaguuguaccaaguaauccau

SEQ ID NO: 2196 - RNA, 28 nt, Artificial Sequence
  Synthetic
uagauugcaguucuacgaaguaauccau

SEQ ID NO: 2197 - RNA, 28 nt, Artificial Sequence
  Synthetic
uagauugcaguuguaccaagaaauccau

SEQ ID NO: 2198 - RNA, 28 nt, Artificial Sequence
  Synthetic
uagauugcuguuguacgaaguaauccau

SEQ ID NO: 2199 - RNA, 28 nt, Artificial Sequence
  Synthetic
uagauugcuguuguaccaagaaauccau

SEQ ID NO: 2200 - RNA, 28 nt, Artificial Sequence
  Synthetic
uagauugcuguuguaccaaguaaugcau

SEQ ID NO: 2201 - RNA, 56 nt, Artificial Sequence; identical to SEQ ID NO: 72
  Synthetic

SEQ ID NO: 2202 - RNA, 28 nt, Artificial Sequence
  Synthetic
aucauugcuguucuaccaaguaauccau

SEQ ID NO: 2203 - RNA, 28 nt, Artificial Sequence
  Synthetic
uagauacguguucuaccaaguaauccau

SEQ ID NO: 2204 - RNA, 28 nt, Artificial Sequence
  Synthetic
uagauugcugaaguaccaaguaauccau

SEQ ID NO: 2205 - RNA, 28 nt, Artificial Sequence
  Synthetic
uagauugcuguuguagguaguaauccau

SEQ ID NO: 2206 - RNA, 28 nt, Artificial Sequence
  Synthetic
uagauugcuguucuaccaagauuuccau

SEQ ID NO: 2207 - RNA, 28 nt, Artificial Sequence
  Synthetic
uagauugcuguucuaccaaguaaucgua

SEQ ID NO: 2208 - RNA, 28 nt, Artificial Sequence
  Synthetic
ccaccccaauaucgaaggggucuaaaac

SEQ ID NO: 2209 - RNA, 28 nt, Artificial Sequence
  Synthetic
ccaccccaauaucgaaggggaguaaaac

SEQ ID NO: 2210 - RNA, 27 nt, Artificial Sequence
  Synthetic
ccaccccaauaucgaaggggcuaaaac

SEQ ID NO: 2211 - RNA, 27 nt, Artificial Sequence
  Synthetic
ccaccccaauaucgaaggggauaaaac

SEQ ID NO: 2212 - RNA, 28 nt, Artificial Sequence
  Synthetic
ccaccccaauaucgaaggggacaaaaac

SEQ ID NO: 2213 - RNA, 28 nt, Artificial Sequence
  Synthetic
ccaccccaauaucgaaggggacuuaaac

SEQ ID NO: 2214 - RNA, 27 nt, Artificial Sequence
  Synthetic
ccaccccaauaucgaaggggacaaaac

SEQ ID NO: 2215 - RNA, 27 nt, Artificial Sequence
  Synthetic
ccaccccaauaucgaaggggacuaaac

SEQ ID NO: 2216 - RNA, 28 nt, Artificial Sequence
  Synthetic
ccaccccaauaucgaaggggacuauaac

SEQ ID NO: 2217 - RNA, 28 nt, Artificial Sequence
  Synthetic
ccaccccaauaucgaaggggacuaauac

SEQ ID NO: 2218 - RNA, 26 nt, Artificial Sequence
  Synthetic
ccaccccaauaucgaaggggacuaac

SEQ ID NO: 2219 - RNA, 25 nt, Artificial Sequence
  Synthetic
ccaccccaauaucgaaggggacuac

SEQ ID NO: 2220 - RNA, 28 nt, Artificial Sequence
  Synthetic
ccaccccaauaucgaaggggacuaaauc

SEQ ID NO: 2221 - RNA, 28 nt, Artificial Sequence
  Synthetic
ccaccccaauaucgaaggggacuaaaag

SEQ ID NO: 2222 - RNA, 24 nt, Artificial Sequence
  Synthetic
ccaccccaauaucgaaggggacuc

SEQ ID NO: 2223 - RNA, 27 nt, Artificial Sequence
  Synthetic
ccaccccaauaucgaaggggacuaaaa

SEQ ID NO: 2224 - RNA, 28 nt, Artificial Sequence
  Synthetic
ccaccccaauaucgaaggggacuaaaac

SEQ ID NO: 2225 - RNA, 173 nt, Artificial Sequence; identical to SEQ ID NO: 142
  Synthetic

SEQ ID NO: 2226 - RNA, 28 nt, Artificial Sequence
  Synthetic
uagauugcuguucuaccaaguaauccau

SEQ ID NO: 2227 - RNA, 176 nt, Artificial Sequence; identical to SEQ ID NO: 146
  Synthetic

SEQ ID NO: 2228 - RNA, 28 nt, Artificial Sequence
  Synthetic
uagauugcuguucuaccaaguaauccau

SEQ ID NO: 2229 - DNA, 35 bp, Alicyclobacillus acidoterrestris
gtcggatcactgagagcggatctgagaagtggcac

SEQ ID NO: 2230 - DNA, 37 bp, Desulfonatronum thiodismutans
gtctcggcaagcttcgtcagtgttgggtgtatggcac

SEQ ID NO: 2231 - RNA, 30 nt, Artificial Sequence
  Synthetic
ccacccgcaauaucgaagcgggacuaaaac

SEQ ID NO: 2232 - RNA, 28 nt, Artificial Sequence
  Synthetic
ccacccaauaaucgaaggggacuaaaac

SEQ ID NO: 2233 - RNA, 78 nt, Artificial Sequence; identical to SEQ ID NO: 1222
  Synthetic

What is claimed:

1. An engineered composition formulated for use in eukaryotic cells comprising
    i) a Cas polypeptide, or a polynucleotide encoding the Cas polypeptide, the Cas polypeptide comprising two higher eukaryotes and prokaryotes nucleotide-binding (HEPN) domains and comprising 95% sequence identity to any one of the polypeptides of SEQ ID NO: 573-591, wherein the Cas polypeptide comprises one or more nuclear localization sequences and the polynucleotide encoding the Cas polypeptide is optionally codon optimized for expression in eukaryotic cells; and
    ii) one or more nucleic acid components, or a polynucleotide encoding the one or more nucleic acid components, wherein the one or more nucleic acid components is capable of forming a CRISPR-Cas complex with the Cas polypeptide, and wherein said one or more nucleic acid components can direct sequence specific binding of the complex to a target sequence of a RNA polynucleotide.

2. The composition of claim 1, wherein the Cas polypeptide is a Type VI Cas polypeptide.

3. An engineered composition comprising
    i) a Cas polypeptide, or a polynucleotide encoding the Cas polypeptide, the Cas polypeptide comprising 95% sequence identity to any one of the polypeptides of SEQ ID NO: 573-587 and 591, and comprising one or more mutations that abrogate nuclease activity, the one or more mutations corresponding to substitutions in the polypeptide of SEQ ID NO: 591 selected from the group consisting of R597A, H602A, R1278A and H1283A; and
    ii) one or more nucleic acid components, or a polynucleotide encoding the one or more nucleic acid components, wherein the one or more nucleic acid components is capable of forming a CRISPR-Cas complex with the Cas polypeptide, and wherein said one or more nucleic acid components can direct sequence specific binding of the complex to a target sequence of a RNA polynucleotide.

4. The composition of claim 1, wherein the Cas polypeptide is from a bacteria belonging to a genus selected from the group consisting of: *Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifactor, Mycoplasma, Camplyobacter, Leptotrichia, Rhodobacter, Lachnospiraceae, Carnobacterium,* and *Paludibacter.*

5. The composition of claim 1, wherein the one or more nucleic acid components comprise a dual direct repeat sequence.

6. The composition of claim 1, wherein the polynucleotide encoding the Cas polypeptide and/or the polynucleotide encoding the one or more nucleic acid components are operably configured to express the polypeptide and/or the one or more nucleic acid components.

7. The composition of claim 6, wherein the polynucleotide encoding the Cas polypeptide and/or the polynucleotide encoding the one or more nucleic acid components comprise one or more regulatory elements operably configured to express the polypeptide and/or the one or more nucleic acid components, and wherein the one or more regulatory elements optionally comprise promoters or inducible promoters.

8. The composition of claim 3, wherein the complex delivers an epigenetic modifier, or a transcriptional or translational activation or repression signal.

9. The composition of claim 3, wherein the complex delivers a functional domain that modifies transcription or translation of the target sequence.

10. The composition of claim 1, wherein the polynucleotide encoding the Cas polypeptide and the polynucleotide encoding the one or more nucleic acid components are comprised within one or more vectors.

11. The composition of claim 10, wherein the one or more vectors are viral vectors are selected from retroviral, lentiviral, adenoviral, adeno-associated and herpes simplex viral vectors.

12. The composition of claim 1, wherein the polynucleotide molecules encoding the Cas polypeptide and/or the one or more nucleic acid components are comprised in a delivery system.

13. The composition of claim 12, wherein the polynucleotide molecules encoding the Cas polypeptide and the one or more nucleic acid components comprise one or more regulatory elements operably configured to express the polypeptide and/or the one or more nucleic acid components, and the one or more regulatory elements comprise a promoter or an inducible promoter.

14. The composition of claim 1, wherein the complex or one or more of its components is comprised in a delivery system.

15. The composition of claim 3, wherein the Cas polypeptide is a Type VI Cas polypeptide.

16. The composition of claim 3, wherein the Cas polypeptide is from a bacteria belonging to a genus selected from the group consisting of: *Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifactor, Mycoplasma, Camplyobacter, Leptotrichia, Rhodobacter, Lachnospiraceae, Carnobacterium,* and *Paludibacter.*

17. The composition of claim 3, wherein the Cas polypeptide comprises at least one or more nuclear localization signals.

18. The composition of claim 3, wherein the one or more nucleic acid components comprise a dual direct repeat sequence.

19. The composition of claim 3, wherein the polynucleotide encoding the Cas polypeptide and/or the polynucleotide encoding the one or more nucleic acid components are operably configured to express the polypeptide and/or the nucleic acid components.

20. The composition of claim 3, wherein the polynucleotide encoding the Cas polypeptide and/or the polynucleotide encoding the one or more nucleic acid components are comprised within one or more vectors.

21. The composition of claim 20, wherein the one or more vectors are viral vectors are selected from retroviral, lentiviral, adenoviral, adeno-associated and herpes simplex viral vectors.

22. The composition of claim 21, wherein the polynucleotide molecules encoding the Cas polypeptide and/or the one or more nucleic acid components are comprised in a delivery system.

\* \* \* \* \*

UNITED STATES PATENT AND TRADEMARK OFFICE
CERTIFICATE OF CORRECTION

| | | |
|---|---|---|
| PATENT NO. | : 11,060,115 B2 | |
| APPLICATION NO. | : 15/482603 | |
| DATED | : July 13, 2021 | |
| INVENTOR(S) | : Severinov et al. | |

It is certified that error appears in the above-identified patent and that said Letters Patent is hereby corrected as shown below:

On the Title Page

Item (71), in Column 1, in "Applicants", Line 13, delete "by," and insert -- by --.

In the Specification

In Column 1, Line 6, after "application" delete "is".

In Column 1, Line 19, delete "DK97768" and insert -- DK097768 --.

In Column 1, Line 36, delete "3480US" and insert -- 3480US1 --.

In Column 9, Line 46, delete "Legionella" and insert -- Legionella, --.

In Column 12, Line 28, delete "% b" and insert -- ½b --.

In Column 13, Line 48, delete "C2cp," and insert -- C2c1p, --.

In Column 20, Line 22, delete "cas" and insert -- cas1 --.

In Column 20, Line 36, delete "(C2c" and insert -- (C2c1 --.

In Column 22, Line 54, delete "FIGs." and insert -- FIG. --.

In Column 24, Line 49, delete "(T)" and insert -- (T1) --.

In Column 28, Lines 30-37, delete "FIG. 112D. in vitro Lshc2c2 cleavage assaying double mismatches in the crRNA. Consecutive double mismatches in the middle of the crRNA abrogate LshC2c2 activity. Locations of mismatches are shown in italics; all mismatches are transversions. FIG. 112A discloses SEQ ID NO: 2058. FIG. 112B discloses SEQ ID NO: 2059. FIG. 112C discloses SEQ ID NO: 2060.

Signed and Sealed this
Fourteenth Day of June, 2022

Katherine Kelly Vidal
*Director of the United States Patent and Trademark Office*

CERTIFICATE OF CORRECTION (continued)
U.S. Pat. No. 11,060,115 B2

FIG. 112D discloses SEQ ID NO: 2061." and insert same on, in Column 28, Line 29, as continuation of the same paragraph.

In Column 32, Line 25, delete "log 2" and insert -- log2 --.

In Column 32, Lines 42-45, delete "FIG. 129B Quantitation of MS2 plaque assay demonstrating interference by top hits. Interference was quantified by highest dilution without plaques. FIG. 129A discloses SEQ ID NOS 2151-2154, respectively, in order of appearance." and insert same on, in Column 32, Line 41, as continuation of the same paragraph.

In Column 35, Line 19, delete "FIG." and insert -- FIGS. --.

In Column 40, Line 3, delete "X);" and insert -- 1); --.

In Column 40, Line 5, delete "X);" and insert -- 2); --.

In Column 40, Line 7, delete "X)" and insert -- 3) --.

In Column 40, Line 7, delete "X);" and insert -- 4); --.

In Column 40, Line 10, delete "X);" and insert -- 5); --.

In Column 40, Line 12, delete "X)" and insert -- 6) --.

In Column 40, Line 14, delete "X)" and insert -- 7) --.

In Column 40, Line 14, delete "X)" and insert -- 8) --.

In Column 40, Line 15, delete "X)" and insert -- 9) --.

In Column 40, Line 17, delete "X)" and insert -- 10) --.

In Column 40, Line 18, delete "X)" and insert -- 11) --.

In Column 40, Line 18, delete "X)" and insert -- 12) --.

In Column 40, Line 19, delete "NS;" and insert -- NS1; --.

In Column 40, Line 19, delete "X)" and insert -- 13) --.

In Column 40, Line 21, delete "X)" and insert -- 14) --.

In Column 40, Line 21, delete "Mxl" and insert -- Mx1 --.

In Column 40, Line 22, delete "X)" and insert -- 15) --.

CERTIFICATE OF CORRECTION (continued)
U.S. Pat. No. 11,060,115 B2

In Column 40, Line 24, delete "X)" and insert -- 16) --.

In Column 42, Line 19, delete "/mtjournal/" and insert -- /mt/journal/ --.

In Column 42, Line 20, delete "/mt2008l44a)." and insert -- /mt2008144a). --.

In Column 42, Line 36, delete "IL," and insert -- II, --.

In Column 42, Line 39, delete "P-actin" and insert -- β-actin --.

In Column 47, Line 13, delete "10.1016j." and insert -- 10.1016/j. --.

In Column 49, Lines 5-6, delete "CMLXBurnett" and insert -- CML) (Burnett --.

In Column 51, Line 59, delete "ADARI" and insert -- ADAR1 --.

In Column 52, Line 46, delete "P-actin" and insert -- β-actin --.

In Column 65, Line 5, delete "Beischmiedia," and insert -- Beilschmiedia, --.

In Column 65, Line 6, delete "Cinis," and insert -- Citrus, --.

In Column 65, Line 7, delete "Cofea," and insert -- Coffea, --.

In Column 65, Line 9, delete "Helianthus" and insert -- Helianthus, --.

In Column 65, Line 10, delete "Limim," and insert -- Linum, --.

In Column 65, Line 10, delete "Lvcopersicon," and insert -- Lycopersicon, --.

In Column 65, Line 10, delete "Lupimis," and insert -- Lupinus, --.

In Column 65, Lines 12-13, delete "Prumis," and insert -- Prunus, --.

In Column 65, Line 13, delete "Stephania" and insert -- Stephania, --.

In Column 65, Line 14, delete "Theobrora," and insert -- Theobroma, --.

In Column 65, Line 21, delete "Pimis," and insert -- Pinus, --.

In Column 68, Line 1, delete "2p" and insert -- 2μ --.

In Column 69, Line 1, delete "ah," and insert -- al., --.

In Column 72, Line 34, delete "instance" and insert -- instance, --.

CERTIFICATE OF CORRECTION (continued)

U.S. Pat. No. 11,060,115 B2

In Column 73, Line 38, delete "i.e." and insert -- i.e., --.

In Column 75, Line 12, delete "10.1016j." and insert -- 10.1016/j. --.

In Column 88, Line 47, delete "P-actin" and insert -- β-actin --.

In Column 88, Line 53, delete "P-globin" and insert -- β-globin --.

In Column 90, Line 10, delete "A. R" and insert -- A. R. --.

In Column 91, Line 65, delete "Mycoplasma" and insert -- Mycoplasma, --.

In Column 91, Line 67, delete "Neisseria Roseburia" and insert -- Neisseria, Roseburia, --.

In Column 92, Line 1, delete "Nitraifractor," and insert -- Nitratifractor, --.

In Column 92, Line 24, delete "Sutterella" and insert -- Sutterella, --.

In Column 92, Line 24, delete "Legionell," and insert -- Legionella, --.

In Column 92, Line 24, delete "Treponema" and insert -- Treponema, --.

In Column 92, Line 24, delete "Fiifactor," and insert -- Filifactor, --.

In Column 92, Line 25, delete "Mycoplasma" and insert -- Mycoplasma, --.

In Column 92, Line 26, delete "Flaviivola" and insert -- Flaviivola, --.

In Column 92, Line 27, delete "Neisseria Roseburia" and insert -- Neisseria, Roseburia, --.

In Column 93, Line 41, delete "I," and insert -- II, --.

In Column 94, Line 32, delete "(PCT/UJS2013/074667)" and insert -- (PCT/US2013/074667) --.

In Column 95, Line 55, delete "Mxl" and insert -- Mx1 --.

In Column 98, Line 21, delete "80°/%," and insert -- 80%, --.

In Column 99, Line 29, delete "ncRNA," and insert -- IncRNA, --.

In Column 103, Line 58, delete "$1\times10^9$" and insert -- $1\times10^8$ --.

In Column 105, Line 65, delete "PKC7" and insert -- PKCγ --.

In Column 109, Line 28, delete "pmol/" and insert -- μmol/ --.

CERTIFICATE OF CORRECTION (continued)
U.S. Pat. No. 11,060,115 B2

In Column 110, Line 52, delete "desorption/onization" and insert -- desorption/ionization --.

In Column 111, Line 18, delete "W2015089419" and insert --WO2015089419 --.

In Column 111, Line 49, delete "poly(p-amino" and insert -- poly(β-amino --.

In Column 114, Line 53, delete "R-3-[(o-" and insert -- R-3-[(ω- --.

In Column 115, Line 9, delete "mmoI/I" and insert -- mmol/l --.

In Column 116, Line 9, delete "495:S4-S16," and insert -- 495:S14-S16, --.

In Column 117, Line 24, delete "m" and insert -- $m^{-2}$ --.

In Column 119, Line 35, delete "ρF" and insert -- μF --.

In Column 119, Line 57, delete "p-amyloid" and insert -- β-amyloid --.

In Column 123, Line 35, delete "IL-Ira" and insert -- IL-1ra --.

In Column 123, Line 61, delete "Na2HPO4," and insert -- $Na_2HPO_4$, --.

In Column 124, Line 29, delete "0.110.04" and insert -- 0.11±0.04 --.

In Column 137, Line 20, delete "250 C" and insert -- 25° C. --.

In Column 137, Line 32, delete "500 C" and insert -- 50° C. --.

In Column 140, Line 8, delete "4" and insert -- $4^{th}$ --.

In Column 142, Line 19, delete "(e.g." and insert -- (e.g., --.

In Column 145, Line 16, delete "p-globin" and insert -- β-globin --.

In Column 146, Line 19, delete "pYepSecl" and insert -- pYepSec1 --.

In Column 161, Line 9, delete "TADAL." and insert -- TADA1. --.

In Column 163, Line 53, delete "MyDl," and insert -- MyoD1, --.

In Column 163, Line 58, delete "MyoD," and insert -- MyoD1, --.

In Column 164, Lines 55-56, delete "wasgiven toproteinsand" and insert -- was given to proteins and --.

In Column 164, Lines 56-57, delete "ofsmallsizetofacilitate" and insert -- of small size to facilitate --.

In Column 164, Line 61, delete "beor" and insert -- be or --.

In Column 165, Lines 30-31, delete "therepressordomains ofthepresent inventionmay beselectedfrom histonemethyltransferases" and insert -- the repressor domains of the present invention may be selected from histone methyltransferases --.

In Column 165, Line 38, delete "bea" and insert -- be a --.

In Column 165, Line 40, delete "MCCP2," and insert -- MeCP2, --.

In Column 165, Line 41, delete "RCORL.NcoR" and insert -- RCOR1. NcoR --.

In Column 165, Line 42, delete "envisaed" and insert -- envisaged --.

In Column 167, Line 2, delete "aMethyltransferase" and insert -- a Methyltransferase --.

In Column 167, Line 5, delete "SET," and insert -- SET1, --.

In Column 167, Line 6, delete "itis" and insert -- it is --.

In Columns 167-168, Lines 8-9 (TABLE 6), delete "linker (SEQ ID NO: 49) +" and insert -- linker + --.

In Column 167, Line 66, delete "SET/TAF-1p" and insert -- SET/TAF-1β --.

In Column 169, Line 41, delete "(e.g." and insert -- (e.g., --.

In Column 169, Line 43, delete "e.g." and insert -- e.g., --.

In Column 170, Line 31, delete "PoV." and insert -- PoIV. --.

In Column 172, Line 58, delete "BCL1A" and insert -- BCL11A --.

In Column 173, Line 63, delete "CIR," and insert -- C1R, --.

In Column 174, Lines 6-7, delete "C3H-OT1/2," and insert -- C3H-10T1/2, --.

In Column 174, Line 12, delete "Hepalclc7," and insert -- Hepa1c1c7, --.

In Column 174, Line 17, delete "MTD-A," and insert -- MTD-1A, --.

In Column 174, Line 25, delete "(Manassas," and insert -- (Manassus, --.

In Column 177, Line 16, delete "TO" and insert -- T0 --.

In Column 177, Line 16, delete "TArabidopsis" and insert -- T1Arabidopsis --.

In Column 183, Lines 58-59, delete "seniledementia," and insert -- senile dementia, --.

In Column 183, Line 64, delete "andgangliocytoma," and insert -- and gangliocytoma, --.

In Column 183, Line 65, delete "postencephaliticparkinsonism," and insert -- postencephalitic parkinsonism, --.

In Column 183, Line 67, delete "Hallervorden-Spatzdisease," and insert -- Hallervorden-Spatz disease, --.

In Column 184, Lines 56-57, delete "mutationsdisruptingthcis-actingsplicingcodcausesplicingdefectsand" and insert -- mutations disrupting the cis-acting splicing code cause splicing defects and --.

In Column 191, Line 37, delete "C2c" and insert -- C2c1 --.

In Column 195, Line 26, delete "$C_1$" and insert -- $C_{1-6}$ --.

In Column 196, Line 25, delete "PoB," and insert -- PolB, --.

In Column 196, Lines 31-32, delete "(transposasentegrase)" and insert -- (transposase/integrase) --.

In Column 196, Line 40, delete "(Nuftez" and insert -- (Nuñez --.

In Column 196, Line 55, delete "3(6):e81)," and insert -- 3(6):e181), --.

In Column 197, Line 28, delete "cas" and insert -- cas1 --.

In Column 197, Line 51, delete "90%" and insert -- ~90% --.

In Column 200, Lines 37-42, delete "FIGS. 9, 14 and 15; and FIGS. 41A-41B, 42A-42B, and 43A-43B). Although bacteriophages infecting bacteria that harbor the newly discovered class 2 CRISPR-Cas systems are virtually unknown, for each of these systems, we detected spacers that matched phages or predicted prophages." and insert same on, in Column 200, Line 36, as continuation of the same paragraph.

In Column 201, Line 45, delete "mixed/conformation" and insert -- mixed α/β conformation --.

In Column 203, Line 64, delete "mixed/O" and insert -- mixed α/β --.

In Column 207, Line 36, delete "system; Koonin" and insert -- system (Koonin --.

In Column 252, Line 39, delete "CRSPR" and insert -- CRISPR --.

In Column 263, Line 28, delete "type II-A" and insert -- type III-A --.

CERTIFICATE OF CORRECTION (continued)
U.S. Pat. No. 11,060,115 B2

In Column 263, Line 32, delete "allow-copy" and insert -- a low-copy --.

In Column 263, Line 50, delete "log 2-fold" and insert -- log2-fold --.

In Column 265, Line 61, delete "R" and insert -- R. --.

In Column 270, Line 15, delete "7*10" and insert -- 7*10^10 --.

In Column 271, Line 39, delete "sM" and insert -- µM --.

In Column 271, Lines 42-64, delete "Cell paste was resuspended in 200 mL of Lysis Buffer (50 mM Hepes pH 7, 2M NaCl, 5 mM MgCl2, 20 mM imidazole) supplemented with protease inhibitors (Roche cOmplete, EDTA-free) and lysozyme. Once homogenized, cells were lysed by sonication (Branson Sonifier 450) then centrifuged at 10,000 g for 1 hour to clear the lysate. The lysate was filtered through 0.22 micron filters (Millipore, Stericup) applied to a Ni-NTA superflow nickel resin (Qiagen), washed, and then eluted with a gradient of imidazole. Fractions containing protein of the expected size were pooled, TEV protease (Sigma) was added, and the sample was dialyzed overnight into TEV buffer (500 mM NaCl, 50 mM Hepes pH 7, 5 mM MgCl, 2 mM DTT). after dialysis, TEV cleavage was confirmed by SDS-PAGE, and the sample was concentrated to 500 µL prior to loading on a gel filtration Column (HiLoad 16/600 Superdex 200) via FPLC (AKTA Pure). Fractions from gel filtration were analyzed by SDS-PAGE; fractions containing C2c2 were pooled and concentrated to 200 µL and either used directly for biochemical assays or frozen at –80° C. for storage. Gel filtration standards were run on the same column equilibrated in 2M NaCl, Hepes pH 7.0 to calculate the approximate size of LshC2c2." and insert same on, in Column 271, Line 43, as a new paragraph.

In Column 271, Line 43, delete "MgC2," and insert -- MgCl2, --.

In Column 272, Line 60, delete "Ipmol" and insert -- 1 pmol --.